(12) United States Patent
Yie et al.

(10) Patent No.: US 10,294,303 B2
(45) Date of Patent: May 21, 2019

(54) METHOD OF TREATING OR AMELIORATING METABOLIC DISORDERS USING BINDING PROTEINS FOR GASTRIC INHIBITORY PEPTIDE RECEPTOR (GIPR) IN COMBINATION WITH GLP-1 AGONISTS

(71) Applicant: AMGEN INC., Thousand Oaks, CA (US)

(72) Inventors: Junming Yie, Warren, NJ (US); Donghui Shi, Thousand Oaks, CA (US); David J. Lloyd, Thousand Oaks, CA (US); Jinghong Wang, Palo Alto, CA (US); Glenn N. Sivits, Jr., Newbury, CA (US); Murielle M. Veniant-Ellison, Thousand Oaks, CA (US); Renee Komorowski, Ventura, CA (US); Neeraj Agrawal, Thousand Oaks, CA (US); Darren L. Bates, Oak Park, CA (US); Brandon C. P. Clavette, Coquitlam (CA); Ian N. Foltz, Burnaby (CA); Shu-yin Ho, Thousand Oaks, CA (US); Christopher Murawsky, Roberts Creek (CA); Xiaoshan Min, Burlingame, CA (US); Zhulun Wang, Palo Alto, CA (US)

(73) Assignee: AMGEN INC., Thousand Oaks, CA (US)

( * ) Notice: Subject to any disclaimer, the term of this patent is extended or adjusted under 35 U.S.C. 154(b) by 0 days.

(21) Appl. No.: 15/387,542

(22) Filed: Dec. 21, 2016

(65) Prior Publication Data

US 2017/0275370 A1 Sep. 28, 2017

Related U.S. Application Data

(60) Provisional application No. 62/420,415, filed on Nov. 10, 2016, provisional application No. 62/337,799, filed on May 17, 2016, provisional application No. 62/387,486, filed on Dec. 23, 2015.

(51) Int. Cl.
| | | |
|---|---|---|
| A61K 39/39 | (2006.01) | |
| C07K 16/28 | (2006.01) | |
| A61K 38/26 | (2006.01) | |
| A61K 39/395 | (2006.01) | |
| A61K 9/00 | (2006.01) | |
| A61K 38/17 | (2006.01) | |
| A61K 39/00 | (2006.01) | |

(52) U.S. Cl.
CPC ........ *C07K 16/2869* (2013.01); *A61K 9/0019* (2013.01); *A61K 38/1703* (2013.01); *A61K 38/26* (2013.01); *A61K 39/3955* (2013.01); *A61K 2039/505* (2013.01); *A61K 2039/54* (2013.01); *C07K 2299/00* (2013.01); *C07K 2317/21* (2013.01); *C07K 2317/32* (2013.01); *C07K 2317/33* (2013.01); *C07K 2317/41* (2013.01); *C07K 2317/52* (2013.01); *C07K 2317/71* (2013.01); *C07K 2317/76* (2013.01); *C07K 2317/92* (2013.01)

(58) Field of Classification Search
CPC .................................................. C07K 16/2869
See application file for complete search history.

(56) References Cited

U.S. PATENT DOCUMENTS

| | | |
|---|---|---|
| 3,773,919 A | 11/1973 | Boswell et al. |
| 4,399,216 A | 8/1983 | Axel et al. |
| 4,740,461 A | 4/1988 | Kaufman |
| 4,816,567 A | 3/1989 | Cabilly et al. |
| 4,912,040 A | 3/1990 | Kaufman et al. |
| 4,946,778 A | 8/1990 | Ladner et al. |
| 4,959,455 A | 9/1990 | Clark et al. |
| 4,965,195 A | 10/1990 | Namen et al. |
| 4,968,607 A | 11/1990 | Dower et al. |
| 5,011,912 A | 4/1991 | Hopp et al. |
| 5,260,203 A | 11/1993 | Ladner et al. |
| 5,292,658 A | 3/1994 | Cormier et al. |
| 5,418,155 A | 5/1995 | Cormier et al. |
| 5,470,582 A | 11/1995 | Supersaxo et al. |
| 5,530,101 A | 6/1996 | Queen et al. |
| 5,545,618 A | 8/1996 | Buckley et al. |
| 5,545,806 A | 8/1996 | Lonberg et al. |
| 5,545,807 A | 8/1996 | Surami et al. |
| 5,569,825 A | 10/1996 | Lonberg et al. |
| 5,585,089 A | 12/1996 | Queen et al. |
| 5,625,126 A | 4/1997 | Lonberg et al. |

(Continued)

FOREIGN PATENT DOCUMENTS

| | | |
|---|---|---|
| AU | 31399/84 A | 1/1984 |
| EP | 0 036 676 A1 | 9/1981 |

(Continued)

OTHER PUBLICATIONS

Rudikoff et al., Proc. Natl. Acad. Sci. 79: 1979-1983, 1982.*
Chamov and Ashkanazi, TIBTECH 14: 52-60, 1996.*
Almind, K. et al., "Discovery of amino acid variants in the human glucose-dependent insulinotropic polypeptide (GIP) receptor: the impact on the pancreatic beta cell responses and functional expression studies in Chinese hamster fibroblast cells," *Diabetologia*, 41:1194-1198 (1998).
Althage, M. C. et al., "Targeted Ablation of Glucose-dependent Insulinotropic Polypeptide-producing Cells in Transgenic Mice Reduces Obesity and Insulin Resistance Induced by a High Fat Diet," *The Journal of Biological Chemistry*, 283(26) :18365-18376 (2008).

(Continued)

*Primary Examiner* — Gyan Chandra
(74) *Attorney, Agent, or Firm* — Jonathan M. Dermott

(57) ABSTRACT

Methods of treating metabolic diseases and disorders using an antigen binding protein specific for the GIPR polypeptide are provided. In various embodiments the metabolic disease or disorder is type 2 diabetes, obesity, dyslipidemia, elevated glucose levels, elevated insulin levels and diabetic nephropathy. In certain embodiments the antigen binding protein is administered in combination with a GLP-1 receptor agonist.

14 Claims, 92 Drawing Sheets

Specification includes a Sequence Listing.

(56) References Cited

U.S. PATENT DOCUMENTS

| | | |
|---|---|---|
| 5,633,425 A | 5/1997 | Lonberg et al. |
| 5,661,016 A | 8/1997 | Lonberg et al. |
| 5,683,888 A | 11/1997 | Campbell |
| 5,693,761 A | 12/1997 | Queen et al. |
| 5,693,762 A | 12/1997 | Queen et al. |
| 5,741,668 A | 4/1998 | Ward et al. |
| 5,770,429 A | 6/1998 | Lonberg et al. |
| 5,777,079 A | 7/1998 | Tsien et al. |
| 5,789,650 A | 8/1998 | Lonberg et al. |
| 5,804,387 A | 9/1998 | Cormack et al. |
| 5,814,318 A | 9/1998 | Lonberg et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,397 A | 3/1999 | Lonberg et al. |
| 5,925,558 A | 7/1999 | Tsien et al. |
| 6,114,598 A | 9/2000 | Kucherlapati et al. |
| 6,162,963 A | 12/2000 | Kucherlapati et al. |
| 6,180,370 B1 | 1/2001 | Queen et al. |
| 6,255,458 B1 | 7/2001 | Lonberg et al. |
| 6,270,964 B1 | 8/2001 | Michnick et al. |
| 6,300,129 B1 | 10/2001 | Lonberg et al. |
| 6,506,724 B1 | 1/2003 | Hiles et al. |
| 6,565,841 B1 | 5/2003 | Niven et al. |
| 6,673,986 B1 | 1/2004 | Kucherlapati et al. |
| 6,703,359 B1 | 3/2004 | Young et al. |
| 6,713,610 B1 | 3/2004 | Kucherlapati et al. |
| 6,753,165 B1 | 6/2004 | Cox et al. |
| 6,833,268 B1 | 12/2004 | Green et al. |
| 6,858,576 B1 | 2/2005 | Young et al. |
| 6,872,700 B1 | 3/2005 | Young et al. |
| 6,902,744 B1 | 6/2005 | Emmot |
| 6,956,026 B2 | 10/2005 | Beeley et al. |
| 7,045,337 B2 | 5/2006 | Schultz et al. |
| 7,049,426 B2 | 5/2006 | Green et al. |
| 7,064,244 B2 | 6/2006 | Jakobovits et al. |
| 7,081,473 B2 | 7/2006 | Tsubamoto et al. |
| 7,091,183 B1 | 8/2006 | Wolfe et al. |
| 7,157,555 B1 | 1/2007 | Beeley et al. |
| 7,220,721 B1 | 5/2007 | Beeley et al. |
| 7,223,725 B1 | 5/2007 | Beeley et al. |
| 7,368,427 B1 | 5/2008 | Dong et al. |
| 7,456,254 B2 | 11/2008 | Wright et al. |
| 7,521,423 B2 | 4/2009 | Young et al. |
| 7,572,451 B2 | 8/2009 | Bachmann et al. |
| 7,666,838 B2 | 2/2010 | O'Harte et al. |
| 7,875,587 B2 | 1/2011 | Gault et al. |
| 7,959,924 B2 | 6/2011 | Bachmann et al. |
| 8,263,545 B2 | 9/2012 | Levy et al. |
| 8,999,940 B2 | 4/2015 | Dong |
| 2003/0036504 A1 | 2/2003 | Kolterman et al. |
| 2003/0157107 A1 | 8/2003 | Miyawaki et al. |
| 2004/0029805 A1 | 2/2004 | Wolfe et al. |
| 2004/0106547 A1 | 6/2004 | Larsen et al. |
| 2005/0159379 A1 | 7/2005 | McSwiggen et al. |
| 2006/0068910 A1 | 3/2006 | Schmidt et al. |
| 2006/0094652 A1 | 5/2006 | Levy et al. |
| 2006/0125763 A1 | 6/2006 | Akai et al. |
| 2008/0125371 A1 | 5/2008 | Wolfe et al. |
| 2008/0182795 A1 | 7/2008 | Wolfe et al. |
| 2008/0312098 A1 | 12/2008 | Kozian et al. |
| 2008/0312157 A1 | 12/2008 | Levy et al. |
| 2009/0036364 A1 | 2/2009 | Levy et al. |
| 2009/0042922 A1 | 2/2009 | Romo et al. |
| 2009/0186817 A1 | 7/2009 | Ghosh et al. |
| 2009/0209469 A1 | 8/2009 | Kim et al. |
| 2010/0143392 A1 | 6/2010 | Bachmann et al. |
| 2011/0136737 A1 | 6/2011 | Levy et al. |
| 2012/0101037 A1 | 4/2012 | Danho et al. |
| 2012/0157379 A1 | 6/2012 | Hsu |
| 2012/0238493 A1 | 9/2012 | DiMarchi et al. |
| 2012/0322725 A1 | 12/2012 | DiMarchi et al. |
| 2013/0344524 A1 | 12/2013 | Miyachi et al. |

FOREIGN PATENT DOCUMENTS

| | | |
|---|---|---|
| EP | 0 058 481 A1 | 8/1982 |
| EP | 0 088 046 A2 | 9/1983 |
| EP | 0 133 988 A2 | 3/1985 |
| EP | 0 143 949 A1 | 6/1985 |
| EP | 0 367 566 A1 | 5/1990 |
| EP | 0 367 566 B1 | 5/1990 |
| EP | 0 460 846 A1 | 12/1991 |
| EP | 0 460 846 B1 | 12/1991 |
| EP | 0 546 073 B1 | 9/1997 |
| EP | 1 283 058 A1 | 2/2003 |
| WO | 88/01649 A1 | 3/1988 |
| WO | 90/04036 A1 | 4/1990 |
| WO | 91/10741 A1 | 7/1991 |
| WO | 92/03918 A1 | 3/1992 |
| WO | 92/15673 A1 | 9/1992 |
| WO | 92/22646 A1 | 12/1992 |
| WO | 93/01227 A1 | 1/1993 |
| WO | 93/15722 A1 | 8/1993 |
| WO | 94/02602 A1 | 2/1994 |
| WO | 94/20069 A1 | 9/1994 |
| WO | 95/07463 A1 | 3/1995 |
| WO | 96/33735 A1 | 10/1996 |
| WO | 98/05351 A1 | 2/1998 |
| WO | 98/14605 A1 | 4/1998 |
| WO | 98/24464 A1 | 6/1998 |
| WO | 98/24893 A2 | 6/1998 |
| WO | 98/26277 A2 | 6/1998 |
| WO | 99/07404 A1 | 2/1999 |
| WO | 99/10494 A2 | 3/1999 |
| WO | 99/25727 A2 | 5/1999 |
| WO | 99/25728 A1 | 5/1999 |
| WO | 99/40788 A1 | 8/1999 |
| WO | 99/49019 A2 | 9/1999 |
| WO | 2007/028633 A2 | 3/2000 |
| WO | 00/20592 A1 | 4/2000 |
| WO | 2000/037098 A1 | 6/2000 |
| WO | 00/41546 A2 | 7/2000 |
| WO | 00/41548 A2 | 7/2000 |
| WO | 00/73331 A2 | 12/2000 |
| WO | 01/51078 A1 | 7/2001 |
| WO | 01/055213 A2 | 8/2001 |
| WO | 01/87341 A1 | 11/2001 |
| WO | 03/072195 A2 | 9/2003 |
| WO | 03/097031 A1 | 11/2003 |
| WO | 03/099314 A1 | 12/2003 |
| WO | 2004/083211 A1 | 9/2004 |
| WO | 2005/000892 A2 | 1/2005 |
| WO | 2005/021022 A2 | 3/2005 |
| WO | 2005/102293 A1 | 11/2005 |
| WO | 2006/045796 A2 | 5/2006 |
| WO | 2006/068910 A1 | 6/2006 |
| WO | 2006/086769 A2 | 8/2006 |
| WO | 2006/086769 A3 | 8/2006 |
| WO | 2006/125763 A1 | 11/2006 |
| WO | 2008/021560 A2 | 2/2008 |
| WO | 2008/021560 A3 | 2/2008 |
| WO | 2009/068910 A1 | 6/2009 |
| WO | 2010/012495 A1 | 2/2010 |
| WO | 2010/016935 A2 | 2/2010 |
| WO | 2010/016936 A2 | 2/2010 |
| WO | 2010/016938 A2 | 2/2010 |
| WO | 2010/016940 A2 | 2/2010 |
| WO | 2010/016944 A2 | 2/2010 |
| WO | 2011/014680 A2 | 2/2011 |
| WO | 2011/094337 A1 | 8/2011 |
| WO | 2012/055770 A1 | 5/2012 |
| WO | 2012/088116 A2 | 6/2012 |
| WO | 2012/167744 A1 | 12/2012 |
| WO | 2015/086853 A1 | 6/2015 |

(56) References Cited

FOREIGN PATENT DOCUMENTS

| | | |
|---|---|---|
| WO | 2015/095354 A2 | 6/2015 |
| WO | 2017/112824 A2 | 6/2017 |

OTHER PUBLICATIONS

American Diabetes Association, Standards of Medical Care in Diabetes—2010, American Diabetes Association, *Diabetes Care*, 33(1):S11-S61 (2010).

Asmar, M. et al., "Glucose-Dependent Insulinotropic Polypeptide May Enhance Fatty Acid Re-esterification in Subcutaneous Abdominal Adipose Tissue in Lean Humans," *Diabetes*, 59:2160-2163 (2010).

Ausubel, F. M. et al., eds., Short Protocols in Molecular Biology, 2nd Edition, A Compendium of Methods from Current Protocols in Molecular Biology, Greene Publishing Associates and John Wiley and Sons, New York Chichester, Brisbane, Toronto (1992) (Table of Contents Only).

Baggio, L. L. et al., "Chronic exposure to GIP-1R agonists promotes homologous GLP-1 receptor desensitization in vitro but does not attenuate GLP-1R-dependent glucose homeostasis in vivo," *Diabetes*, 53(3):5205-5214 (2004).

Beck, B. et al., "Hypersensitivity of Adipose Tissue to Gastric Inhibitory Polypeptide Action in the Obese Zucker Rat," *Cellular and Molecular Biology*, 33(5):555-562 (1987).

Beck, B. et al., "Direct metabolic effects of gastric inhibitory polypeptide (GIP): dissociation at physiological levels of effects on insulin-stimulated fatty acid and glucose incorporation in rat adipose tissue," *Diabetologia*, 29:68 (1986).

Berndt, S. I. et al., "Genome-wide meta-analysis identifies 11 new loci for anthropometric traits and provides insights into genetic architecture," *Nature Genetics*, 45(5):501-512 (2013).

Bianchi, A. A. and McGrew, J. T., "High-Level Expression of Full-Length Antibodies Using Trans-Complementing Expression Vectors," *Biotech Biotechnol. Bioeng.*, 84:439-444 (2003).

Bootcov, M. R. et al., "MIC-1, a novel macrophage inhibitory cytokind, is a divergent member of the TGF-β superfamily," *Proc. Natl. Acad. Sci. USA*, 94:11514-11519 (1997).

Bowie, J. U. et al., "A Method to Identify Protein Sequences That Fold into a Known Three-Dimensional Structure," *Science*, 253:164-170 (1991).

Boylan, M. O. et al., "Gastric inhibitory polypeptide immunoneutralization attenuates development of obesity in mice," *Am J Physiol Endocrinol Metab*, 309 :E1008-E1018 (2015).

Branden, C. and Tooze, J., eds., Introduction to Protein Structure, Garland Publishing, Inc. New York and London (1991) (Table of Contents Only).

Brenner, S. E. et al., "Population statistics of protein structures: lessons from structural classifications," *Curr. Op. Struct. Biol.*, 7:369-376 (1997).

Brons, C. et al., "Impact of short-term high-fat feeding on glucose and insulin metabolism in young healthy men," *The Journal of Physiology*, 587:2387-2397 (2009).

Bruggermann, M. et al., "Design Mice: The Production of Human Antibody Repertoires in Transgenic Animals," *Year in Immunol.*, 7:33-40 (1993).

Campbell, J. E. et al., "TCF1 links GIPR signaling to the control of beta cell function and survival," *Nature Medicine*, 22(1):84-90 (2016).

Carrillo, H. et al., "The Multiple Sequence Alignment Problem in Biology," *SIAM J. Applied Math*, Society for Industrial and Applied Mathematics, 48(5):1073-1082 (1988).

Chalfie, M. et al., "Green Fluorescent Protein as a Marker for Gene Expression," *Science*, 263:802-805 (1994).

Chen, J. et al., "Immunoglobulin gene rearrangement in B cell deficient mice generated by targeted deletion of the $J^H$ locus," *International Immunology*, 5(6):647-656 (1993).

Cheung, R. C. et al., "Epitope-Specific Antibody Response to the Surface Antigen of Duck Hepatitis B Virus in Infected Ducks," *Virology*, 176:546-552 (1990).

Chia, C. W. et al., "Exogenous Glucose-Dependent Insulinotropic Polypeptide Worsens Postprandial Hyperglycemia in Type 2 Diabetes," *Diabetes*, 58:1342-1349 (2009).

Chothia, C. et al., "Conformations of immunoglobulin hypervariable regions," *Nature*, 342:877-883 (1989).

Chothia & Lesk, "Canonical Structures for the Hypervariable Regions of Immunoglobulins," *J. Mol. Biol.*, 196:901-917 (1987).

Chou, P. Y. et al., "Conformational Parameters for Amino Acids in Helical, (β-Sheet, and Random Coil Regions Calculated from Proteins," *Biochemistry*, 13(2):211-222 (1974).

Chou, P. Y. et al., "Prediction of Protein Conformation," *Biochem.*, 13(2):222-245 (1974).

Chou, P. Y. et al., "Prediction of the Secondary Structure of Proteins From Their Amino Acid Sequence," *Adv. Enzymol. Relat. Areas Mol. Biol.*, 47:45-148 (1978).

Chou, P. Y. et al., "Empirical Predictions of Protein Conformation,"*Ann. Rev. Biochem.*, 47:251-276 (1978).

Chou, P. Y. et al., "Prediction of β-Turns," *Biophys. J.*, 26:367-384 (1979).

Cinti, S. S et al., "Adipocyte death defines macrophage localization and function in adipose tissue of obese mice and humans," *Journal of Lipid Research*, 46:2347-2355 (2005).

Coligan, J. E., ed., Current Protocols in Immunology, New York: John Wiley & Sons, Inc. (1993) (Table of Contents Only).

Cosman, D. et al., "Cloning, sequence and expression of human interleukin-2 receptor," *Nature*, 312:768-771 (1984).

Creighton, T. E., Ed., Proteins: Structures and Molecular Principles, 2nd ed., W. H. Freeman and Company, New York (1984) (Table of Contents Only).

Dayhoff, M. O. et al., Atlas of Protein Sequence and Structure, Chapter 22, A Model of Evolutionary Change in Proteins, 5(3):345-352 (1978).

Devereux, J. et al., "A comprehensive set of sequence analysis programs for the VAX," *Nucl. Acid Res.*, Laboratory of Genetics, University of Wisconsin, Madison, WI, 12(1):387-395 (1984).

Dillon, J. S. et al., "Cloning and functional expression of the human glucagon-like peptide-1 (GLP-1) receptor," *Endocrinology*, 133(4):1907-1910 (1993).

Drucker, D. J., "Enhancing incretin action for the treatment of type 2 diabetes," *Diabetes Care*, 26(10):2929-2940 (2003).

Eng et al., "Purification and Structure of Exendin-3, a New Pancreatic Secretagogue Isolated from Heloderma horridum Venom," *The Journal of Biological Chemistry*, 265(33):20259-202262 (1990).

Eppstein, D. A. et al., "Biological activity of liposomes-encapsulated murine interferon γ is mediated by a cell membrane receptor," *Proc. Natl. Acad. Sci. USA* 82:3688-3692 (1985).

Evans, B. E. et al., "Design of Nonpeptidal Ligands for a Peptide Receptor: Cholecystokinin Antagonists," *J. Med. Chem.*, 30:1229-1239 (1987).

Fairlie, W. D., "Expression of a TGF-β superfamily protein, macrophage inhibitory cytokine-1, in the yeast *Pichia pastoris*," *Gene*, 254:67-76 (2000).

Falko, J. M. et al., "Gastric Inhibitory Polypeptide (GIP) Stimulated by Fat Ingestion in Man," *JCE&M*, 41(2):260-265 (1975).

Fauchere, J-L., "Elements for the Rational Design of Peptide Drugs," *Adv. Drug Res.*, 15:29-69 (1986).

Fehmann, H. et al. "Cell and Molecular Biology of the Incretin Hormones Glucagon-Like Peptide-I and Glucose-Dependent Insulin Releasing Polypeptide," *Endocrine Reviews*, 16(3):390-410 (1995).

Finan, B. et al., "Unimolecular Dual Incretins Maximize Metabolic Benefits in Rodents, Monkeys, and Humans," *Science-Translational Medicine*, 5(209):209ra151 (2013).

Fishwild, D. M. et al., "High-avidity human IgGκ monoclonal antibodies from a novel strain of minilocus transgenic mice," *Nature Biotechnology*, 14:845-851 (1996).

Fulurija, A. et al., "Vaccination against GIP for the Treatment of Obesity," *PloS One*, 3(9):e3163 (2008).

Gault, V. A. et al., "Characterization of the Cellular and Metabolic Effects of a Novel Enzyme-Resistant Antagonist of Glucose-

(56) References Cited

OTHER PUBLICATIONS

Dependent Insulinotropic Polypeptide," *Biochemical and Biophysical Research Communications*, 290(5):1420-1426 (2002).
Genbank Accession No. U55762, "Cloning vector pEGFP-N1, complete sequence, enhanced green fluorescent protein (egfp) and neomycin phosphotransferase genes, complete cds," CLONTECH Labs, Inc., Kitts, P. A., (2003).
Gennaro, A. R., Remington's Pharmaceutical Sciences, 18$^{TH}$ Edition, Mack Publishing Co., Easton, PA (1990) (Table of Contents Only).
Gerhard, D. S. et al., "The Status, Quality, and Expansion of the NIH Full-Length cDNA Project: The Mammalian Gene Collection (MGC)," *Genome Research*, 14:2121-2127 (2004).
Getty-Kaushik, L. et al., "Glucose-Dependent Insulinotropic Polypeptide Modulates Adipocyte Lipolysis and Reesterification," *Obesity*, 14(7):1124-1131 (2006).
Goding, Production of Monoclonal Antibodies, *Monoclonal antibodies: principles and practice: production and application of monoclonal antibodies in cell biology, biochemistry, and immunology*, pp. 59-103 (1986).
Goeddel, D. V., ed., *Methods Enzymol.*, Gene Expression Technology, vol. 185, New York: Academic Press (1990) (Table of Contents Only).
Green, L. L., et al., "Antigen-specific human monoclonal antibodies from mice engineered with human Ig heavy and light chain YACs," *Nature Genetics*, 7:13-21 (1994).
Green, L. L. and Jakobovits, Aya, "Regulation of B Cell Development by Variable Gene Complexity in Mice Reconstituted with Human Immunoglobulin Yeast Artificial Chromosomes," *J. Exp. Med.*, 188(3):483-495 (1998).
Gremlich, S. et al., "Cloning, Functional Expression, and Chromosomal Localization of the Human Pancreatic Islet Glucose-Dependent Insulinotropic Polypeptide Receptor," *Diabetes*, 44:1202-1208, (1995).
Gribskov, M. et al., "Profile analysis: Detection of distantly related proteins," *Proc. Nat. Acad. Sci. USA*, 84:4355-4358 (1987).
Gribskov, M. et al., "Profile Analysis, Searching Databases,"*Meth. Enzym.*, Chapter 9, 183:146-159 (1990).
Gribskov, M. and Devereux, J., eds., Sequence Analysis Primer, New York: M. Stockton Press, (1991) (Table of Contents Only).
Griffin, A. M. and Griffin, H. G., eds., Computer Analysis of Sequence Data, Part I, Humana Press, Totowa, New Jersey (1994) (Table of Contents Only).
Gupta, D. et al., "Physiologic and Pharmacologic Modulation of Glucose-Dependent Insulinotropic Polypeptide (GIP) Receptor Expression in β-Cells by Peroxisome Proliferator-Activated Receptor (PPAR)-γ Signaling: Possible Mechanism for the GIP Resistance in Type 2 Diabetes," *Diabetes*, 59:1445-1450 (2010).
Harding, F. A. and Lonberg, N., "Class Switching in Human Immunoglobulin Transgenic Mice,"*Ann. NY Acad. Sci.*, 765:536-546 (1995).
Hargrove, D. M. et al., "Biological activity of AC3174, a peptide analog of exendin-4," *Regulatory Peptides*, 141:113-119 (2007).
Harlow, E. and Lane, D., Antibodies: A Laboratory Manual, Cold Spring Harbor Laboratory Press, Cold Spring Harbor, NY (1988).
Harlow, E. and Lane, D., Antibodies: A Laboratory Manual, Cold Spring Harbor Laboratory Press, Cold Spring Harbor, NY (1988) (Ed. 1991 and Periodic Supplements) (Table of Contents Only).
Haugland, R. P., Molecular Probes Handbook, A Guide to Fluorescent Probes and Labeling Technologies, 11$^{th}$ Ed. *Invitrogen by ThermoFisher Scientific* (2010) (Table of Contents Only).
Hauner, H. et al., "Effects of Gastric Inhibitory Polypeptide on Glucose and Lipid Metabolism of Isolated Rat Adipocytes,"*Ann. Nutr. Metab.*, 32:282-288 (1988).
Heim, R. et al., "Engineering green fluorescent protein for improved brightness, longer wavelengths and fluorescence resonance energy transfer," *Current Biology*, 6:178-182 (1996).
Henikoff, S. et al., "Amino acid substitution matrices from protein blocks, "*Proc. Natl. Acad. Sci. USA*, 89:10915-10919 (1992).

Hinke, S. A. et al., Identification of a bioactive domain in the amino-terminus of glucose-dependent insulinotropic polypeptide (GIP), *Biochimica et Biophysica Acta*, 1547(1):143-155 (2001).
Højberg, P. V. et al., "Four weeks of near-normalisation or blood glucose improves the insulin response to glucagon-like peptide-1 and glucose-dependent insulinotropic polypeptide in patients with type 2 diabetes," *Diabetologia*, 52:199-207 (2009).
Holm, L. et al., "Protein folds and families: sequence and structure alignments," *Nucleic Acid Research*, 27(1):244-247 (1999).
Hoogenboom et al., "By-passing Immunisation Human Antibodies from Synthetic Repertoires of Germline $V_H$ Gene Segments Rearranged in Vitro,"*J. Mol. Biol.*, 227:381-388 (1991).
Hopp, T. P. et al., "A Short Polypeptide Marker Sequence Useful for Recombinant Protein Identification and Purification," *Bio/Technology*, 6:1204-1210 (1988).
Ichiki, T. et al., "Regulation of the expression of human C epsilon germline transcript. Identification of a novel IL-4 responsive element," *The Journal of Immunology*, 150:5408-5417 (1993).
Inagaki, N. et al., "Gastric Inhibitory Polypeptide: Structure and Chromosomal Localization of the Human Gene,"*Molecular Endocrinology* 3(6):1014-1021 (1989).
Jakobovits, A. et al., "Analysis of homozygous mutant chimeric mice: deletion of the immunoglobulin heavy-chain joining region blocks B-cell development and antibody production," *Proc. Natl. Acad. Sci. USA*, 90:2551-2555 (1993).
Jakobovits, A. et al., "Germ-line transmission and expression of a human-derived yeast artificial chromosome," *Nature*, 362:255-258 (1993).
Jalkanen, M. et al., "Heparan Sulfate Proteoglycans from Mouse Mammary Epithelial Cells: Localization on the Cell Surface with a Monoclonal Antibody," *The Journal of Cell Biology*, 101:976-984 (1985).
Jalkanen, M. et al., "Cell Surface Proteoglycan of Mouse Mammary Epithelial Cells is Shed by Cleavage of Its Matrix-binding Ectodomain from Its Membrane-associated Domain," *The Journal of Cell Biology*, 105(6)(2):3087-3096 (1987).
Jones, P. T. et al., "Replacing the complementarity-determining regions in a human antibody with those from a mouse," *Nature*, 321:522-525 (1986).
Jones, D. T. et al., "Progress in protein structure prediction," *Current Opinion in Structural Biology*, 7:377-387 (1997).
Joo, E. et al., "Inhibition of Gastric Inhibitory Polypeptide Receptor Signaling in Adipose Tissue Reduces Insulin Resistance and Hepatic Steatosis in High-Fat Diet-Fed Mice," *Diabetes*, 66:868-879 (2017).
Kabat, E. A. et al., Sequences of Proteins of Immunological Interest, 5$^{th}$ ed., U.S. Dept. of Health and Human Services, PHS, NIH, Bethesda, MD (1987 and 1991) (Table of Contents Only).
Kabat, E. A. et al., Sequences of Proteins of Immunological Interest, 5$^{th}$ ed., U.S. Dept. of Health and Human Services, PHS, NIH, NIH Publication No. 91-3242, Bethesda, MD.(1991) (Table of Contents Only).
Kellerman, S. and Green, L. L., "Antibody discovery: the use of transgenic mice to generate human monoclonal antibodies for therapeutics," *Current Opinion in Biotechnology*, 13:593-597 (2002).
Kennett, R. H. et al., eds., *Monoclonal Antibodies, Hybridomas: A New Dimension in Biological Analyses*, Plenum Press, New York (1980) (Table of Contents Only).
Kilpatrick, K. E. et al., "Rapid development of affinity matured monoclonal antibodies using Rimms," *Hybridoma*, 16(4):381-389 (1997).
Kim, S. J. et al., "GIP-Overexpressing Mice Demonstrate Reduced Diet-Induced Obesity and Steatosis, and Improved Glucose Homeostasis," *PloS One*, 7(7):e40156 (2012).
Kim, S. J. et al., "Activation of Lipoprotein Lipase by Glucose-dependent Insulinotropic Polypeptide in Adipocytes: A Role for a Protein Kinase B, LKB1, and AMP-Activated Protein Kinase Cascade," *The Journal of Biological Chemistry*, 282(12):8557-8567 (2007).
Kirkland,T. N. et al., "Analysis of the Fine Specificity and Cross-Reactivity of Monoclonal Anti-Lipid A Antibodies," *The Journal of Immunology*, 137(11):3614-3619 (1986).
Knapper, J. M. et al., "Investigations into the Actions of Glucose-Dependent Insulinotropic Polypeptide and Glucagon-Like Peptide-

(56) References Cited

OTHER PUBLICATIONS

1(7-36)amide on Lipoprotein Lipase Activity in Explants of Rat Adipose Tissue," *The Journal of Nutrition*, 125(2):183-188 (1995).
Kostelny, S. A. et al., "Formation of a Bispecific Antibody by the Use of Leucine Zippers," *The Journal of Immunology*, 148(5):1547-1553 (1992).
Kyte, J. et al., "A Simple Method for Displaying the Hydropathic Character of a Protein," *J. Mol. Biol.*, 157:105-132 (1982).
Langer, R. et al., "Biocompatibility of polymeric delivery systems for macromolecules," *Journal of Biomedical Materials. Research*, 15:267-277 (1981).
Langer, R. et al., "Controlled release of macromolecules," *Chem. Tech.*, 12:98-105 (1982).
Lesk, A. M., ed., Computational Molecular Biology, Sources and Methods for Sequence Analysis, New York: Oxford University Press, Oxford New York Tokyo (1988) (Table of Contents Only).
Lewis, J. T. et al. "Glucose-dependent insulinotropic polypeptide confers early phase insulin release to oral glucose in rats: demonstration by a receptor antagonist", *Endocrinology*, 141(10): 3710-3716 (2000).
Lonberg, N. et al., "Antigen-specific human antibodies from mice comprising four distinct genetic modifications," *Nature*, 368:856-859 (1994).
Lonberg, N. et al., *The Pharmacology of Monoclonal Antibodies*—Chapter 3: "Transgenic Approaches to Human Monoclonal Antibodies," *Handbook of Exp. Pharmacology*, 113:49-101 (1994).
Lonberg, N. and Huszar, D., "Human Antibodies from Transgenic Mice," *Intern. Rev. Immunol.*, 13:65-93 (1995).
Lorenz, M. et al., "Recent progress and future options in the development of GLP-1 receptor agonists for the treatment of diabesity," *Bioorg Med Chem Lett*, 23(14):4011-4018 (2013).
Lund, A. et al., "The separate and combined impact of the intestinal hormones, GIP, GLP-1, and GLP-2, on glucagon secretion in type 2 diabetes," *Am J Physiol Endocrinol Metab*, 300:E1038-E1046 (2011).
Marks, J. D. et al., "By-passing Immunization: Human Antibodies and V-gene Libraries Displayed on Phage,"*J. Mol. Biol.*, 222:581-597 (1991).
Mendez et al., "Functional transplant of megabase human immunoglobulin loci recapitulates human antibody response in mice," *Nature Genetics*, 15:146-156 (1997).
Maniatis et al., "Regulation of Inducible and Tissue-Specific Gene Expression," *Science*, 236:1237-1244 (1987).
Meier, J. J. et al., "Gastric inhibitory polypeptide (GIP) dose-dependently stimulates glucagon secretion in healthy human subjects at euglycaemia," *Diabetologia*, 46:798-801 (2003).
Miyawaki, K. et al., "Inhibition of gastric inhibitory polypeptide signaling prevents obesity," *Nature Medicine*, 8(7):738-742 (2002).
Mohammad, S. et al., "A Naturally Occurring GIP Receptor Variant Undergoes Enhanced Agonist-Induced Desensitization, Which Impairs GIP Control of Adipose Insulin Sensitivity,"*Molecular and Cellular Biology*, 34(19):3618-3629 (2014).
Moldenhauer, G. et al., "Identity of HML-1 Antigen on Intestinal Intraepithelial T Cells and of B-ly7 Antigen on Hairy Cell Leukaemia," *Scand. J. Immunol.*, 32:77-82 (1990).
Montgomery, I. A. et al., "Active immunization against (Pro(3))GIP improves metabolic status in high-fat-fed mice," *Diabetes, Obesity & Metabolism*, pp. 744-751 (2010).
Morel et al., "Monoclonal Antibodies to Bovine Serum Albumin: Affinity and Specificity Determinations," *Molecular Immunology*, 25(1):7-15 (1988).
Morrison, S. L. et al., "Chimeric human antibody molecules: Mouse antigen-binding domains with human constant region domains," *Proc. Natl. Acad. Sci. USA*, 81:6851-6855 (1984).
Moult, J. et al., "The current state of the art in protein structure prediction," *Current Opinion in Biotechnology*, 7:422-427 (1996).
Murphy, M. C. et al., "Postprandial lipid and hormone responses to meals of varying fat contents: modulatory role of lipoprotein lipase?," *European Journal of Clinical Nutrition*, 49:579-588 (1995).

Nasteska, D. et al., "Chronic Reduction of GIP Secretion Alleviates Obesity and Insulin Resistance Under High-Fat Diet Conditions," *Diabetes*, 63:2332-2343 (2014).
Nauck, M. A. et al., "Preserved Incretin Activity of Glucagon-like Peptide 1 [7-36 Amide] but Not of Synthetic Human Gastric Inhibitory Polypeptide in Patients with Type-2 Diabetes Mellitus," *J. Clinic. Invest.*, 91:301-307 (1993).
NCBI Reference Sequence: NM_000164, https://www.ncbi.nlm.nih.gov/sviewer.fcgi?noredirect=1&db=nuccore&val=NM_000164.1, (downloaded Nov. 28, 2017).
NCBI Reference Sequence: XP_005258790, https://www.ncbi.nlm.nih.gov/sviewer/viewer.fcgi?db=nuccore&val=XP_005258790&report=genbank, (downloaded Nov. 28, 2017).
NCBI Reference Sequence: NP_001074284, https://www.ncbi.nlm.nih.gov/sviewer/viewer.fcgi?db=protein&val=NP_001074284+&report=genbank, (downloaded Nov. 28, 2017).
NCBI Reference Sequence: NM_001080815, https://www.ncbi.nlm.nih.gov/sviewer/viewer.fcgi?db=protein&val=NM_001080815&report=genbank, (downloaded Nov. 28, 2017).
NCBI Reference Sequence: AAI20674, https://www.ncbi.nlm.nih.gov/sviewer/viewer.fcgi?db=nuccore&val=AAI20674&report=genbank, (downloaded Nov. 28, 2017).
Needleman, S. B. et al., Algorithm, "A General Method Applicable to the Search for Similarities in the Amino Acid Sequence of Two Proteins," *J. Mol. Biol.*, 48:443-453 (1970).
Third Report of the National Cholesterol Education Program (NCEP) Expert Panel on Detection, Evaluation, and Treatment of the High Blood Cholesterol in Adults (adult Treatment Panel III) Final Report, National Institutes of Health, NIH Publication No. 02-5215 (2002).
Nielsen, L. L. et al., "Pharmacology of exenatide (synthetic exendin-4) for the treatment of type 2 diabetes," *Current Opinion in Investigational Drugs*, 4(4):401-405 (2003).
Nolan, G. P. et al., "Flourescence-activated cell analysis and sorting of viable mammalian cells based on beta-D-galactosidase activity after transduction of *Escherichia coli* lacZ," *Proc. Natl. Acad. Sci. USA*, 85:2603-2607 (1988).
Okada, Y. et al., "Common variants at CDKAL1 and KLF9 are associated with body mass indexin east Asian populations," *Nature Genetics*, 44(3):302-306 (2012).
Paul, W. E. et al., *Fundamental Immunology*, $2^{nd}$ ed., Chapter 7: Evolution of the Immune System, pp. 139-165, Raven Press, New York (1989).
Prasad-Reddy, L. et al., "A clinical review of GLP-1 receptor agonists: efficacy and safety in diabetes and beyond," *Drugs in Context*, 4:212283 (2015).
Raufman, J. P. et al., "Truncated Glucagon-like Peptide-1 Interacts with Exendin Receptors on Dispersed Acini from Guinea Pig Pancreas," *The Journal of Biological Chemistry*, 265(30):21432-21437 (1992).
Ravn, P. et al., "Structural and Pharmacological Characterization of Novel Potent and Selective Monoclonal Antibody Antagonists of Glucose-dependent Insulinotropic Polypeptide Receptor," *The Journal of Biological Chemistry*, 288(27):19760-19772, (2013).
Riechmann, L.et al., "Reshaping human antibodies for therapy," *Nature*, 332(24):323-327 (1988).
Rizo, J. and Gierasch, L. M., "Constrained Peptides: Models of Bioactive Peptides and Protein Substructures," *Annual Rev. Biochem.*, 61:387-418 (1992).
Sambrook, J. et al., Molecular Cloning: A Laboratory Manual, $2^{nd}$ ed., Cold Spring Harbor Laboratory Press (1989) (Table of Contents Only).
Sambrook, J. et al., Molecular Cloning: A Laboratory Manual, $3^{rd}$ ed., Cold Spring Harbor Laboratory Press, Cold Spring Harbor, NY (2001) (Table of Contents Only).
Saxena, R. et al., "Genetic variation in GIPR influences the glucose and insulin responses to an oral glucose challenge," *Nature Genetics*, 42(2):142-148 (2010).
Sidman, K. R. et al., "Controlled Release of Macromolecules and Pharmaceuticals from Synthetic Polypeptides Based on Glutamic Acid," *Biopolymers*, 22:547-556 (1983).
Sippl, Manfred J. et al., "Threading thrills and threats," *Structure*, 4:15-19 (1996).

(56) References Cited

OTHER PUBLICATIONS

Smith, D. W., ed., Biocomputing Informatics and Genome Projects, New York: Academic Press (1994) (Table of Contents Only).
Songsivilai, S. and Lachmann, P. J., "Bispecific antibody: a tool for diagnosis and treatment of disease," *Clin. Exp. Immunol.*, 79:315-321 (1990).
Speliotes, E. K. et al., "Association analyses of 249,796 individuals reveal 18 new loci associated with body mass index," *Nature Genetics*, 42(11):937-948 (2010).
Stahli, C. et al., "Distinction of Epitopes by Monoclonal Antibodies," *Methods in Enzymology*, 92:242-253 (1983).
Stauber, R. H., "Developments and Applications of Enhanced Green Fluorescent Protein Mutants," *BioTechniques*, 24(3):462-471 (1998).
Strissel, K. J. et al., "Adipocyte Death, Adipose Tissue Remodeling, and Obesity Complications," *Diabetes*, 56:2910-2918 (2007).
Suzuki, K. et al., "Transcriptional Regulatory Factor X6 (Rfx6) Increases Gastric Inhibitory Polypeptide (GIP) Expression in Enteroendocrine K-cells and Is Involved in GIP Hypersection in High Fat Diet-induced Obesity," *The Journal of Biological Chemistry*, 288(3):1929-1938 (2013).
Taylor, L. D. et al., "A Transgenic mouse that expresses a diversity of human sequence heavy and light chain immunoglobulins," *Nucleic Acids Research*, 20(23):6287-6295 (1992).
Taylor, L. D. et al., "Human immunoglobulin transgenes undergo rearrangement, somatic mutation and class switching in mice that lack endogenous IgM," *International Immunology*, 6(4):579-591 (1994).
Tijssen, *Practice and Theory of Enzyme Immunoassays*, R. H. Burdon and P. H. van Knippenberg, Eds, Elsevier, Amsterdam, vol. 15 (1993) (Table of Contents Only).
Thornton, J. M. et al., "Prediction of progress at last," *Nature*, 354:105-106 (1991).
Trumper, A. et al., "Glucose-Dependent Insulinotropic Polypeptide Is a Growth Factor for β (INS-1) Cells by Pleiotropic Signaling,"*Molecular Endocrinology*, 15(9):1559-1570 (2001).
Tseng, C. C. et al., "Regulation of glucose-dependent insulinotropic peptide gene expression by a glucose meal," *Am J Physiol*, 266(5)(1):G887-891 (1994).
Tsubamoto, Y. et al., "A novel low-molecular-weight antagonist of glucose-dependent insulinotropic polypeptide receptor SKL-14959, prevents obesity and insulin resistance," *Diabetologia*, 51:S373 (2008).
Tuaillon et al., "Biased utilization of DHQ52 and JH4 gene segments in a human Ig transgenic minilocus is independent of antigenic selection," *The Journal of Immunology*, 152:2912-2920 (1994).
UniProtKB Sequence Identifier: P48546-2, http://www.uniprot.org/uniprot/P48546-2.fasta, downloaded Nov. 30, 2017.
UniProtKB/Swiss-Prot Q0P543-1, http://www.uniprot.org/uniprot/Q0P543.fasta, downloaded Dec. 4, 2017.
Usdin, T. B. et al., "Gastric Inhibitory Polypeptide Receptor, a Member or the Secretin-Vasoactive Intestinal Peptide Receptor Family, Is Widely Distributed in Peripheral Organs and the Brain," *Endocrinology*, 133(6):2861-2870 (1993).
Van Heeke, G. & Schuster, S. M., "Expression of Human Asparagine Synthetase in *Escherichia coli*," *The Journal of Biological Chemistry*, 264(10):5503-5509 (1989).
Vassilatis et al., "The G Protein-coupled receptor repertoires of human and mouse," *PNAS USA*, 100(8):4903-4908 (2003).
Veber, D. F. and Freidinger, R. M., "The design of metabolically-stable peptide analogs," *TINS*, p. 392-396 (1985).
Verhoeyen, M. et al., "Reshaping Human Antibodies: Grafting an Antilysozyme Activity," *Science*, 239:1534-1536 (1988).
Vilsboll, T. et al., "Incretin Secretion in Relation to Meal Size and Body Weight in Healthy Subjects and People with Type 1 and Type 2 Diabetes Mellitus," *The Journal of Clinical Endocrinology & Metabolism*, 88(6):2706-2713 (2003).
Volz, A. et al., "Molecular cloning, functional expression, and signal transduction of the GIP-receptor cloned from a human insulinoma," *FEBS Letters*, 373:23-29 (1995).

Von Heinje, G., Sequence Analysis in Molecular Biology, Academic Press, Inc., New York (1987) (Table of Contents Only).
Voss, S. D. et al., "The role of enhancers in the regulation of cell-type-specific transcriptional control," *TIBS*, 11:287 (1986).
Wen, W. et al., "Meta-analysis identifies common variants associated with body mass index in east Asians," *Nature Genetics*, 44(3):307-311 (2012).
Yamada, Y. et al., "Pancreatic and Extrapancreatic Effects of Gastric Inhibitory polypeptide," *Diabetes*, 55(2):S86-S91 (2006).
Yip, R. G. et al., "Functional GIP Receptors are Present on Adipocytes," *Endocrinology*, 139(9):4004-4007 (1998).
Yutaka, S. et al., "Glucose-dependent insulinotropic polypeptide and glucagon-like peptide-1: Incretin actions beyond the pancreas", *Journal of Diabetes Investigation*, 4(2):108-130 (2013).
Zola, H., *Monoclonal Antibodies: A Manual of Techniques*, "Using Monoclonal Antibodies: Soluble Antigens," CRC Press, Inc., Chapter 6, pp. 147-181 (1987).
Al-Sabah, Suleiman, "Molecular Pharmacology of the Incretin Receptors," *Medical Principles and Practice*, 25(1):15-21 (2016).
Ausubel, F. M. et al., eds., Strauss, William M., Contributor, "Hybridization With Radioactive Probes, Using DNA Fragments as Probes, "*Current Protocols in Molecular Biology,* John wiley and Sons, Inc., Chapter 6, Section II, Supplements 24, 13, and 2,Unit 6.3 (6.3.1. - 6.3.6) (1993), Copyright (2003).
Ausubel, F. M. et al., eds., Duby, Allan, Jacobs, Kenneth A., Celeste, Anthony, Contributors, "Hybridization With Radioactive Probes, Using Synthetic Oligonucleotides as Probes", *Current Protocols in Molecular Biology*, John Wiley and Sons, Inc. Chapter 6, Section II, Supplements 2, 13, and 9, Unit 6.4 (6.4.1 - 6.49) (1993), Copyright (2003).
Ausubel, F. M. et al., eds., "Hybridization with Radioactive Probes, Using DNA Fragments as Probes," *Current Protocols in Molecular Biology*, John Wiley & Sons, Inc., NY, Section II, Supplements Unit 6,3, pgs. 6.3.1-6.3.6 (1989).
Ausubel, F. M. et al., eds., Brown, Terry, Contributor, "Hybridization Analysis of DNA Blots" *Current Protocols in Molecular Biology*, John Wiley and Sons, Inc., Chapter 2, Section IV, Supplements 21, 35, 29, 26, and 42, Unit 2.10 (2.10.1 - 2.10.16) (1993), Copyright (2000).
Behrens, C. R. et al., "Methods for Site-Specific Drug Conjugation to Antibodies," mAbs, 6(1):46-53 (2014) (Downloaded by EPO Aug. 30, 2016).
Bhatnagar, P. K. et al., "Structure—Activity Relationships of Novel Hematoregulatory Peptides,"J Med. Chem., 39:3814-3819 (1996).
Bong, J., "Chemoselective Pd(0)-catelyzed peptide coupling in water," *Organic Letters*, 3(16):2509-2511 (2001).
Creighton, T. E., Ed., *Proteins: Structures and Molecular Principles*, W. H. Freeman and Company, San Francisco, CA, Section About: Hydroxylation of Pro and Lys, pgs 70-86 (1983).
Devasher, R. B. et al., "Aqueous-phase, palladium-catelyzed croscoupling of aryl bromides under mid conditions, using water-soluble, sterically demanding alkylphosphines," J. Org. Chem., 69:7919-7927 (2004).
Dibowski, H. et al., Bioconjugation of peptides by palladium-catalyzed C-C cross-coupling in water, Angew. Chem. Int. Ed., 37(4):476-478 (1998).
Link, A. J. et al., "Non-canonical amino acids in protein engineering," *Current Opinion in Biotechnology*, 14(6):603-609 (2003).
McClean, P. L. et al., "GIP receptor antagonism reverses obesity, insulin resistance, and associated metabolic disturbances induced in mice by prolonged consumption of high-fat diet," *American Journal of Physiology: Endocrinology and Metabol, American Physiological Society, Bethesda, MD, US*,293(6): E1746-E1755 (2007).
NCBI Reference Sequence: NP_000155, https://www.ncbi.nlm.nih.gov/protein/NP_(downloaded Aug. 16, 2018).
Prescher, J. A., and Bertozzi, C. R., Chemistry in living systems, *Nature Chemical Biology*, 1(1):13-21 (2005).
Schumacher, D. et al., "Current Status: Site-Specific Antibody Drug Conjugates," *Journal of Clinical Immunology*, 36(1):100-107 (2016).
Western, E. C. (Including Shaugnessy, K. H as shown in specification) et al., "Efficient One-Step Suzuki Arylation of Unprotected Halonucleosides, Using Water-Soluble Palladium Catalysts," J. Org. Chem., 68:6767-6774 (2003).

(56) References Cited

OTHER PUBLICATIONS

Shinmi, D. et al., "One-Step Conjugation Method for Site-Specific Antibody-Drug Conjugates through Reactive Cysteine-Engineered Antibodies," Bioconjugate Chem, 27(5):1324-1331 (2016).
Wang, Y. J. And Hanson, M. A. et al., "Parenteral Formulations of Proteins and Peptides: Stability and Stabilizers," Journal of Parenteral Science and Technology, Technical Report No. 10, 42(2S): S4-S26 (1988).

* cited by examiner

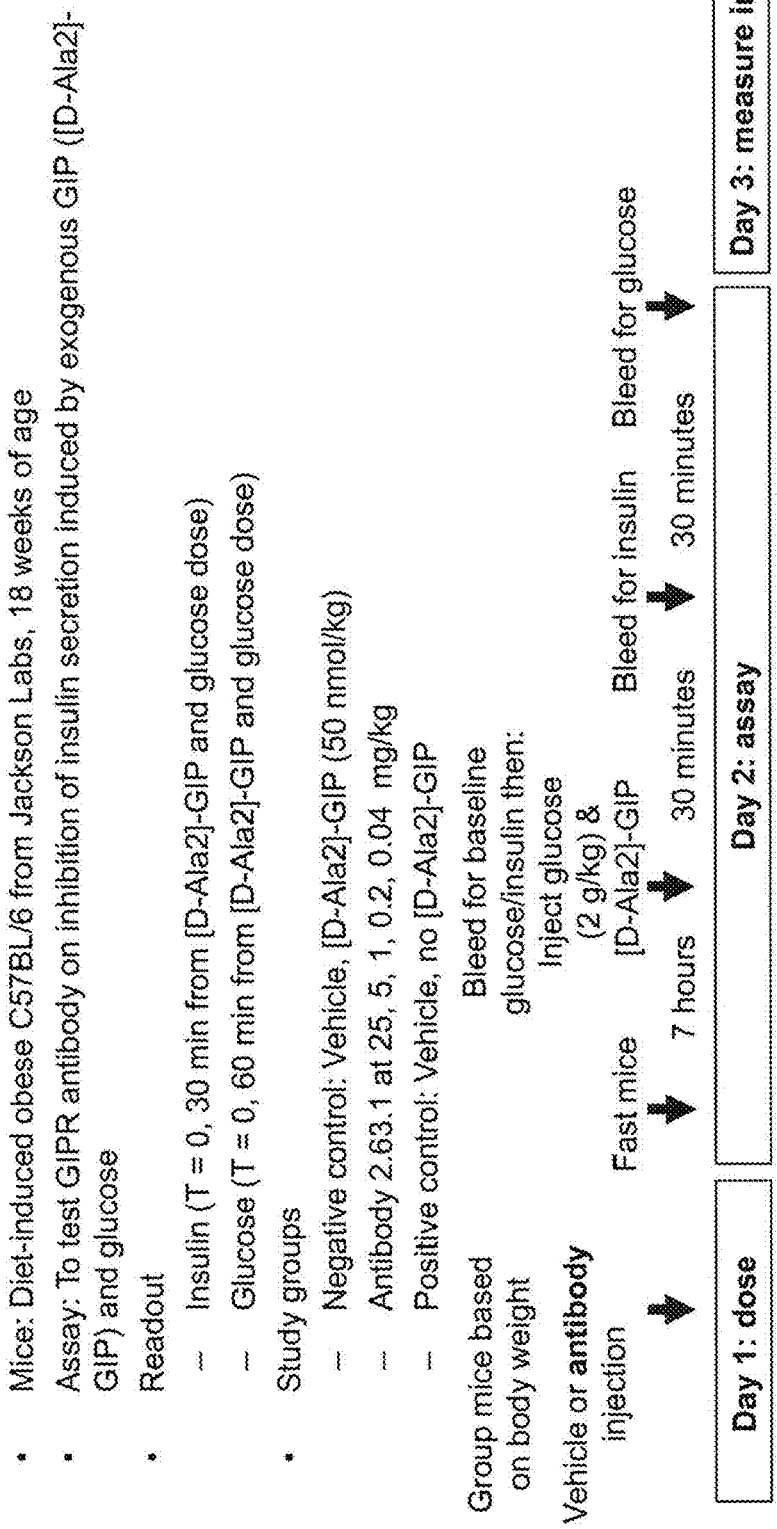

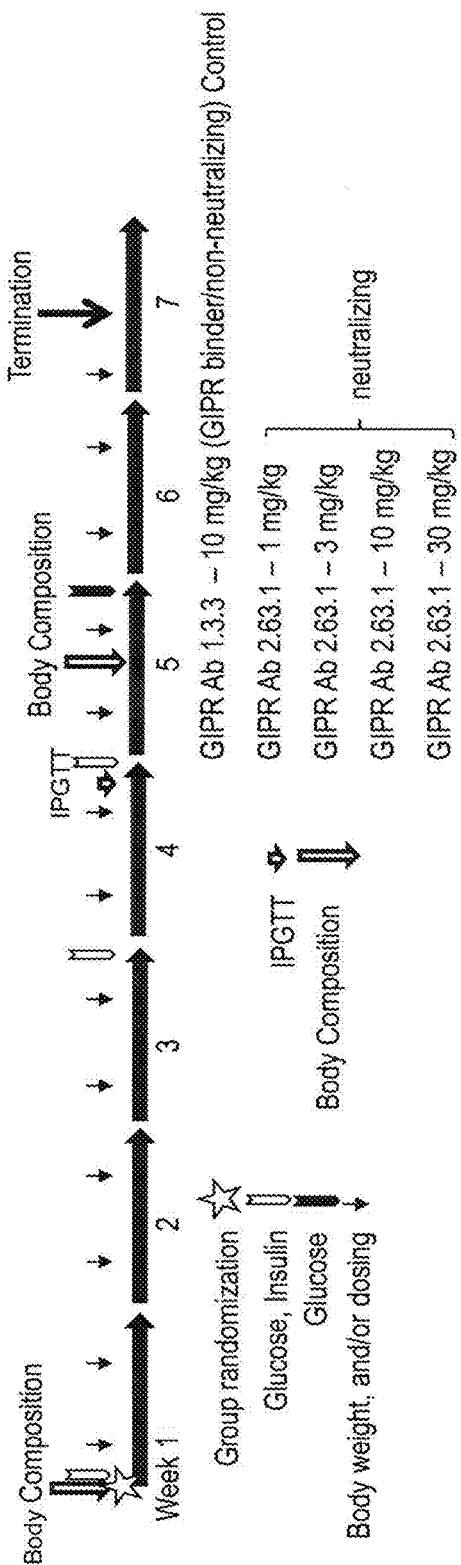

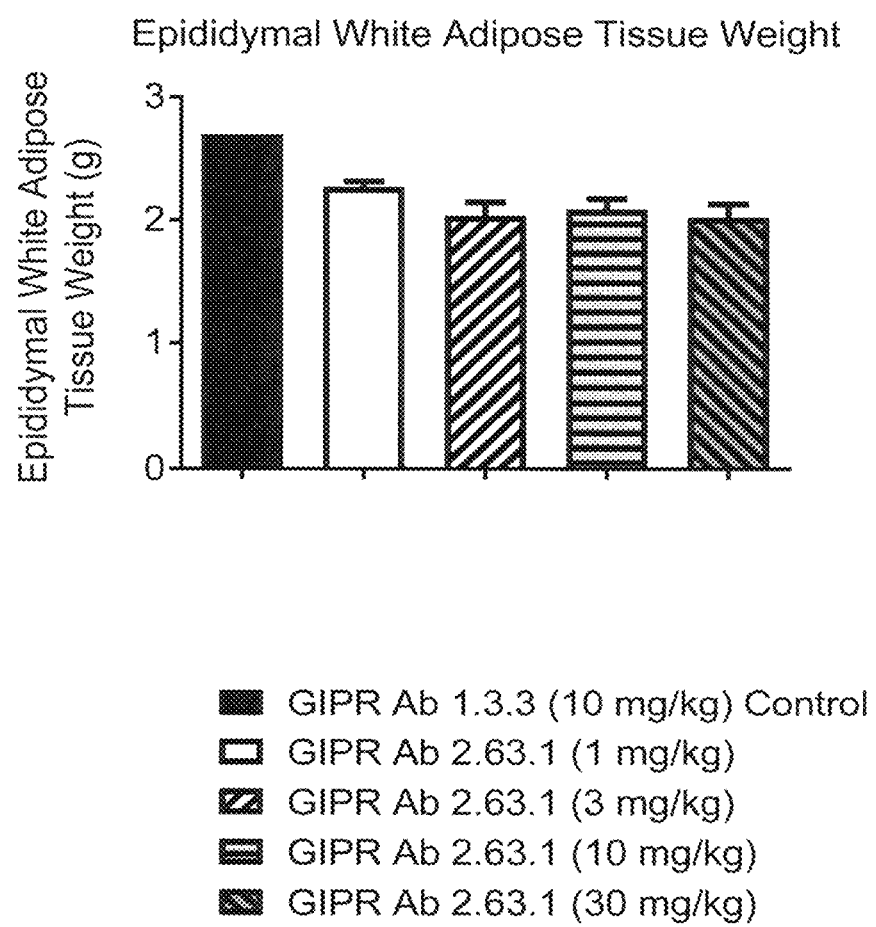

Day -2 Glucose

- GIPR Ab 1.3.3 (10 mg/kg) Control
- GIPR Ab 2.63.1 (1 mg/kg)
- GIPR Ab 2.63.1 (3 mg/kg)
- GIPR Ab 2.63.1 (10mg/kg)
- GIPR Ab 2.63.1 (30mg/kg)

Day 21 Glucose

4H9 Family
kd [1/s]

4H9 Family
IC60 (nM)

18F2 Family
kd [1/s]

x   No Inhibition/Binding

18F2 Family
IC60 (nM)

x   No Inhibition/Binding

6H1 Family
kd [1/s]

6H1 Family
IC60 (nM)

6A5 Family

6A5 Family
IC60 (nM)

5G12 Family
kd [1/s]

5G12 Family
IC60 (nM)

2A11 Family

2A11 Family

2G10 Family
kd [1/s]

2G10 Family
IC60 (nM)

^ Beyond Plotted Range

17H11 Family
kd [1/s]

17H11 Family
IC60 (nM)

18E3 Family
kd [1/s]

18E3 Family
IC60 (nM)

5C2 Family
kd [1/s]

5C2 Family
IC60 (nM)

X  No Inhibition/Binding
^  Beyond Plotted Range

11C1 Family
kd [1/s]

11C1 Family
IC60 (nM)

X   No Inhibition/Binding

2C2 Family
kd [1/s]

2C2 Family
IC60 (nM)

17B11 Family
kd [1/s]

17B11 Family
IC60 (nM)

X  No Inhibition/Binding
∧  Beyond Plotted Range

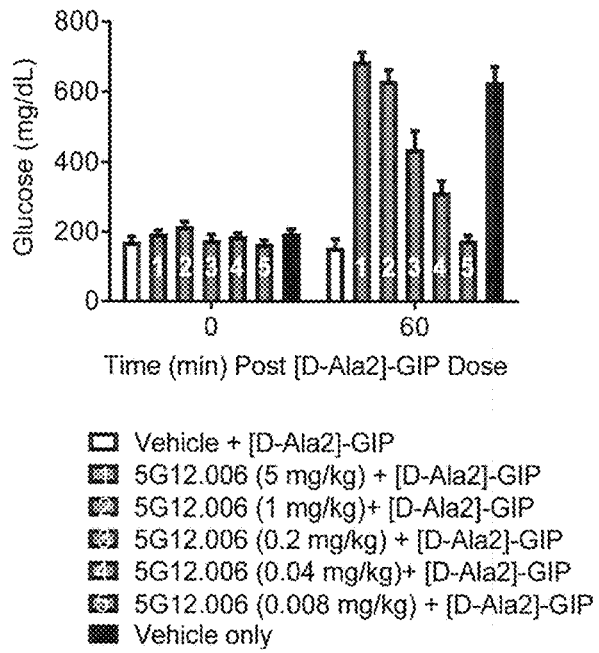
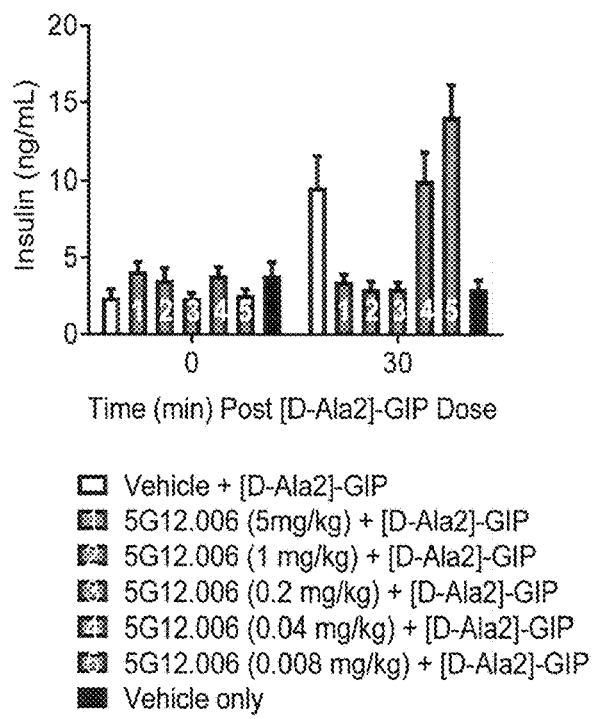

FIG. 18

- Male C57BL/6 Diet-Induced Obese mice (Jackson Lab), 18 weeks old at start (on high fat diet for 12 weeks)
- Mice were randomized based on body weight
- Mice were dosed each week for 4 weeks
- Body weights were recorded twice a week; not fasted glucose measured on day 18 and fasted insulin measured on day 29
- Terminal blood collected for measurement of total cholesterol, and triglycerides
- Intraperitoneal glucose tolerance test (IPGTT) was performed on day 25 with 4 hour fast with 1 g/kg of glucose
- After 4 weeks, study was terminated following a 4 hour fast. Serum samples were collected and livers were weighed
- ➔ = Weekly Dosing

| | |
|---|---|
| Vehicle | |
| GIPR Ab 5G12.006 | 5 mg/kg |
| GIPR Ab 5G12.006 | 1 mg/kg |
| GIPR Ab 5G12.006 | 0.2 mg/kg |
| GIPR Ab 5G12.006 | 0.04 mg/kg |
| GIPR Ab 5G12.006 | 0.008 mg/kg |

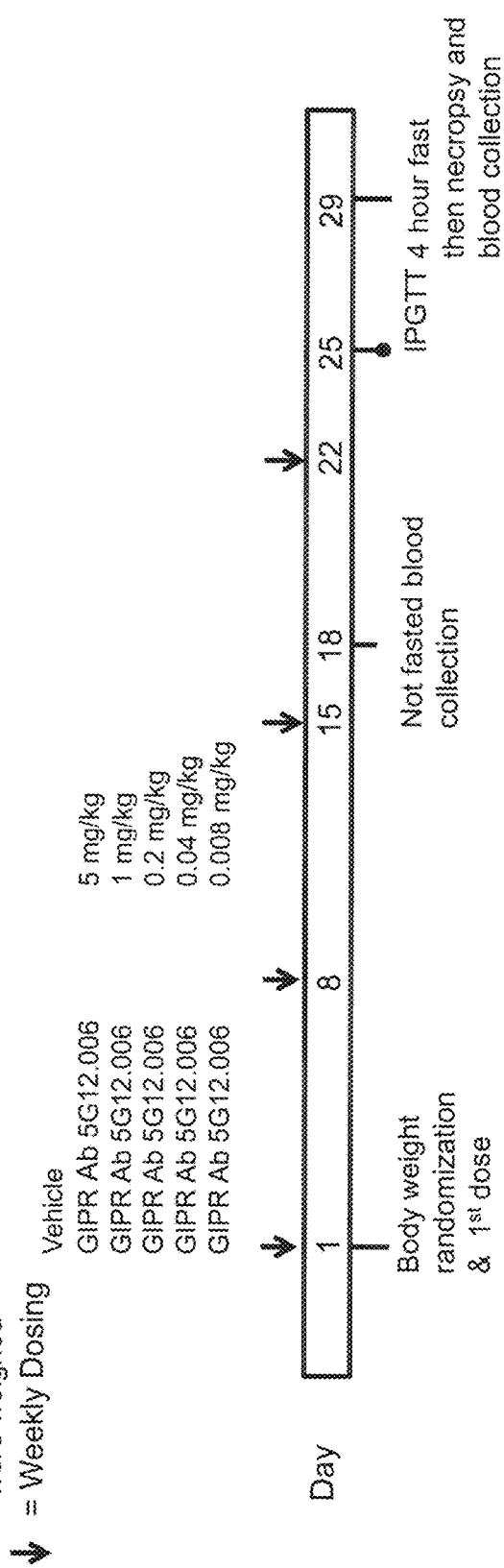

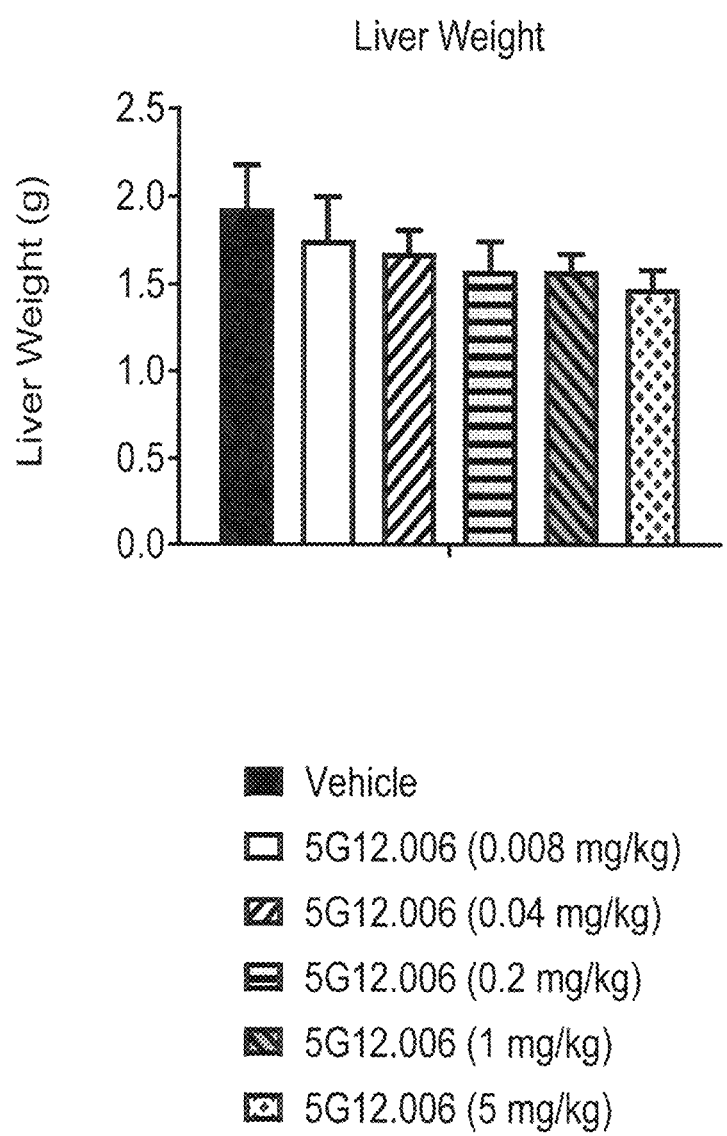

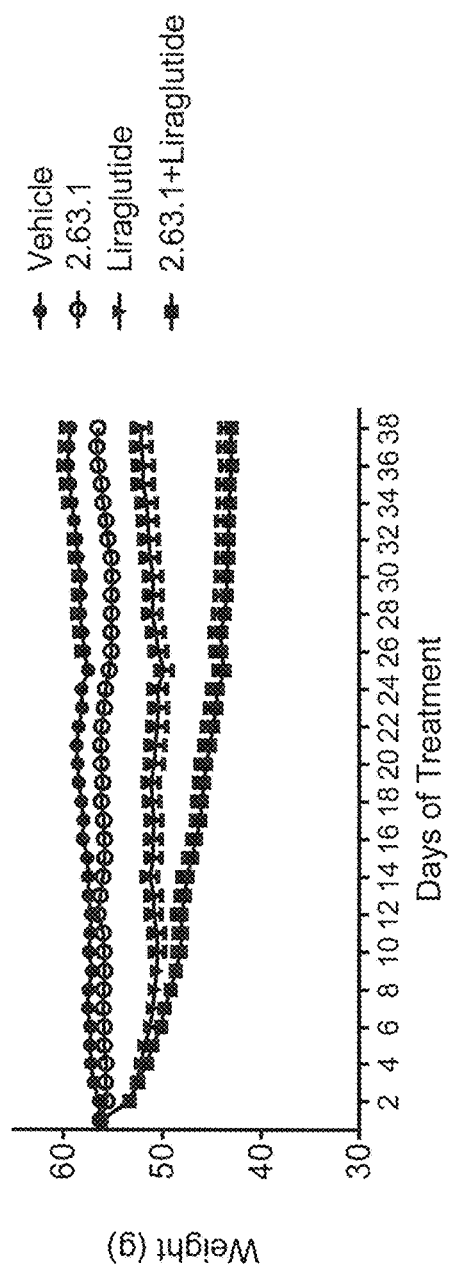
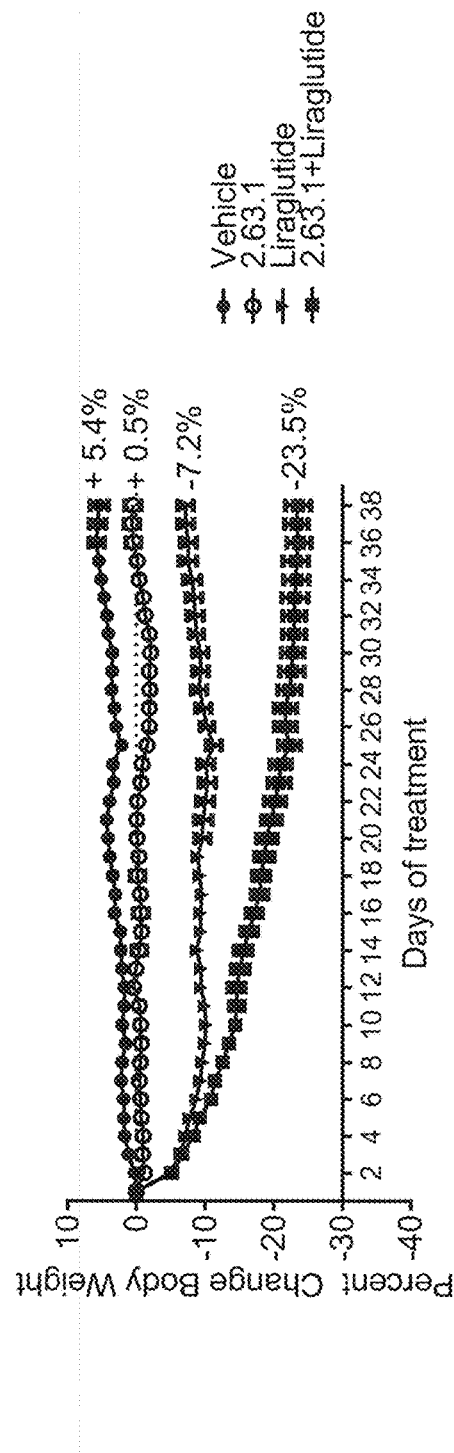

Note:
Food intake data is from the following numbers animals each group
Vehicle: N=6
2.63.1: N=8
Liraglutide: N=4
2.63.1 + Liraglutide: N=3
The other animals played with the food during some of the time points and food intake could not be accurately measured. These animals are not included.

Day -10 baseline Insulin (4h fast)

Day 22 Insulin (fed), 1 h after dose

Day 25 Insulin (4h fast)

Day 39 Insulin (fast)

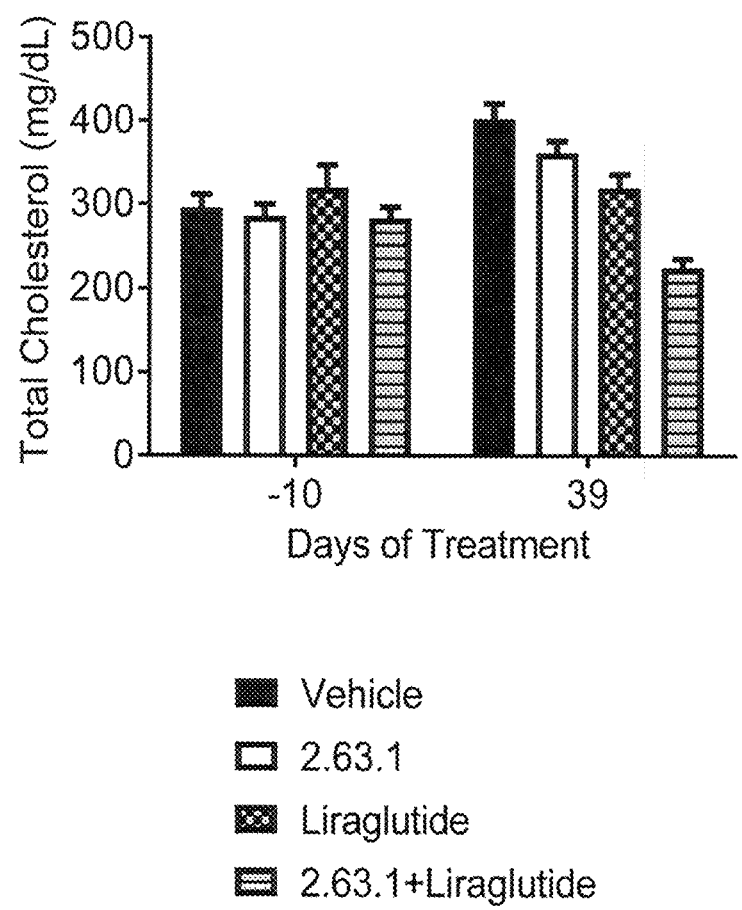

FIG. 35

- Mice: Jackson Labs C57BL/6 DIO, 37 weeks of age (on high fat diet for 31 weeks) at study start
- Group and treatment: N=8/group, dose volume is 5 ml/kg
  - A. Vehicle
  - B. Anti-GIPR mAb 2.63.1 (25 mg/kg, once a week)
  - C. Dulaglutide (1mg/kg, twice a week)
  - D. Anti-GIPR mAb 2.63.1 (25 mg/kg, once a week) + Dulaglutide (1mg/kg, twice a week)
  - E. Liraglutide (0.3 mg/kg, once a day)
  - F. Anti-GIPR mAb 2.63.1 (25 mg/kg, once a week) + Liraglutide (0.3 mg/kg, once a day)
  - G. Exendin IV (0.01 mg/kg, once a day)
  - H. Anti-GIPR mAb 2.63.1 (25 mg/kg, once a week) + Exendin IV (0.01 mg/kg, once a day)
- Procedures:
  - Day -7 to day -1: Acclimation by dosing with vehicle daily for all groups. Body weight, glucose and serum (fast 4 h)
  - Day 1: Body weight, grouping and first dose
- Efficacy readout:
  - Body weight daily
  - Food intake
  - Body composition at beginning and end
  - Glucose, insulin, OGTT at day 23

| Wk-1 | Wk 1 | Wk 2 | Wk 3 | Wk 4 |
|---|---|---|---|---|

↓ 1st dose

Bleed
Body Composition

Body  OGTT  Termination
Composition food Intake food Intake /BW

Food intake data is from the following numbers animals each group
Vehicle: N=6
2.63.1: N=6
Dulaglutide: N=8
2.63.1 + Dulaglutide: N=6   Liraglutide: N=6   2.63.1 + Liraglutide: N=4
Exendin IV: N=7   2.63.1 + Exendin IV: N=4

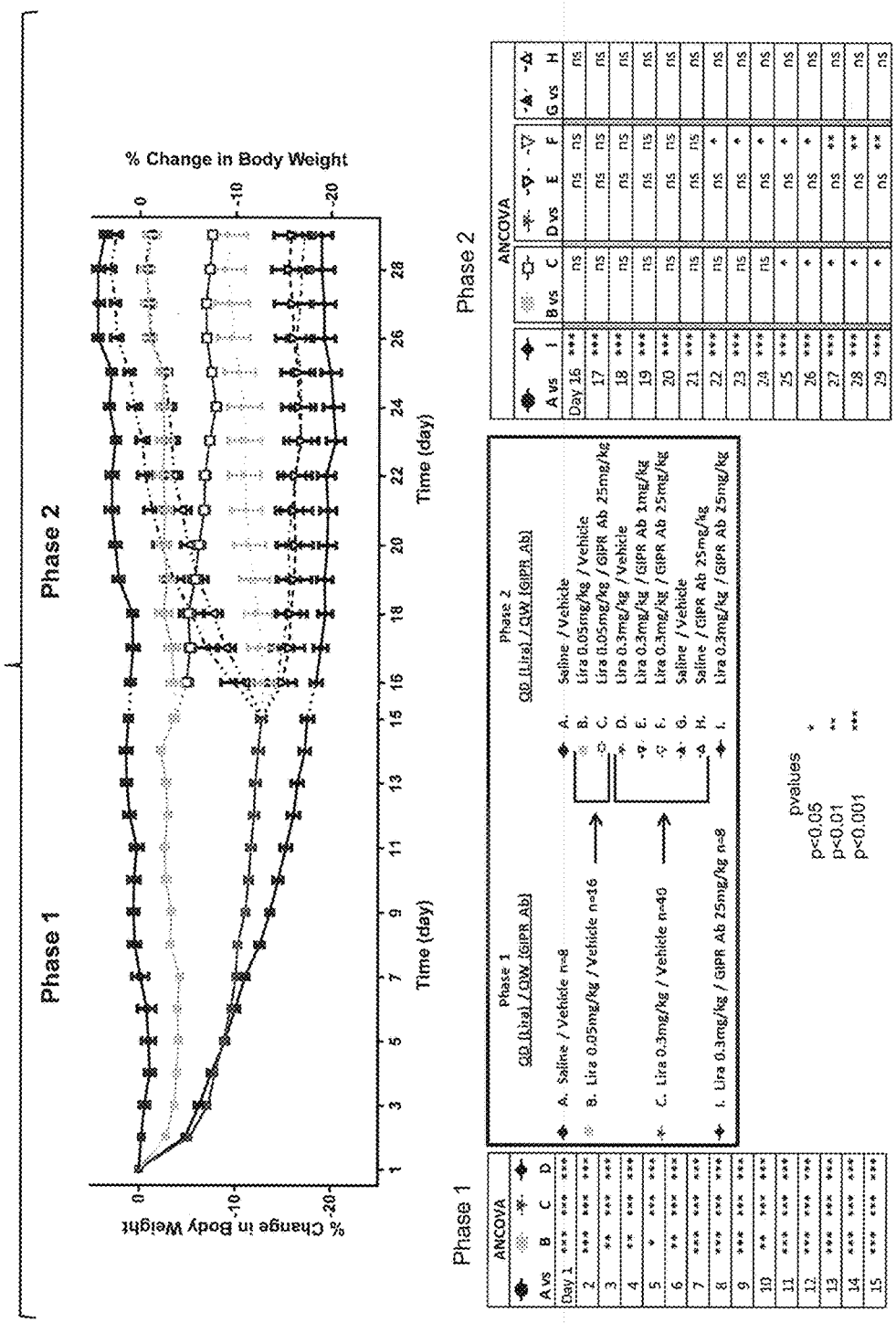

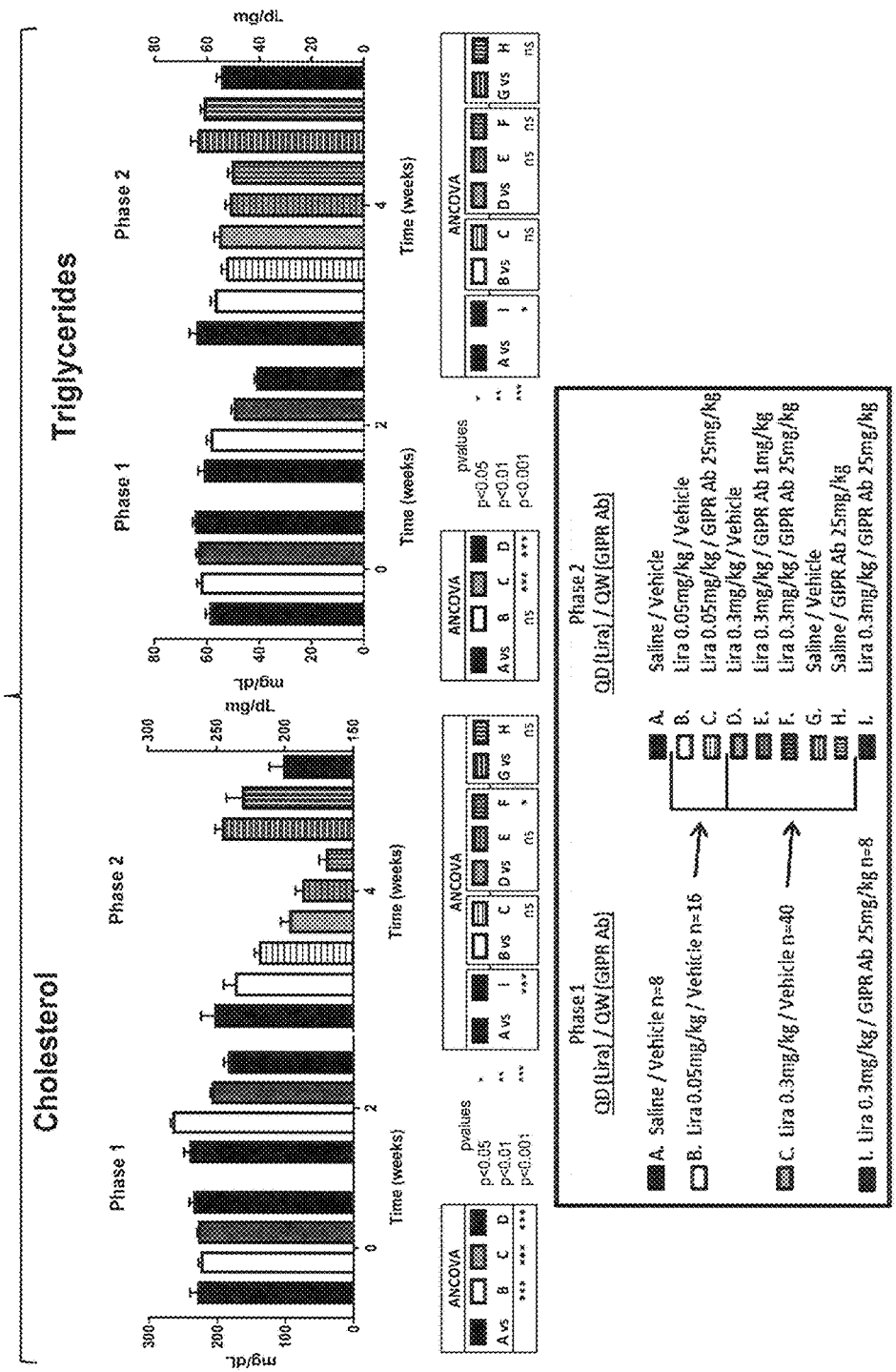

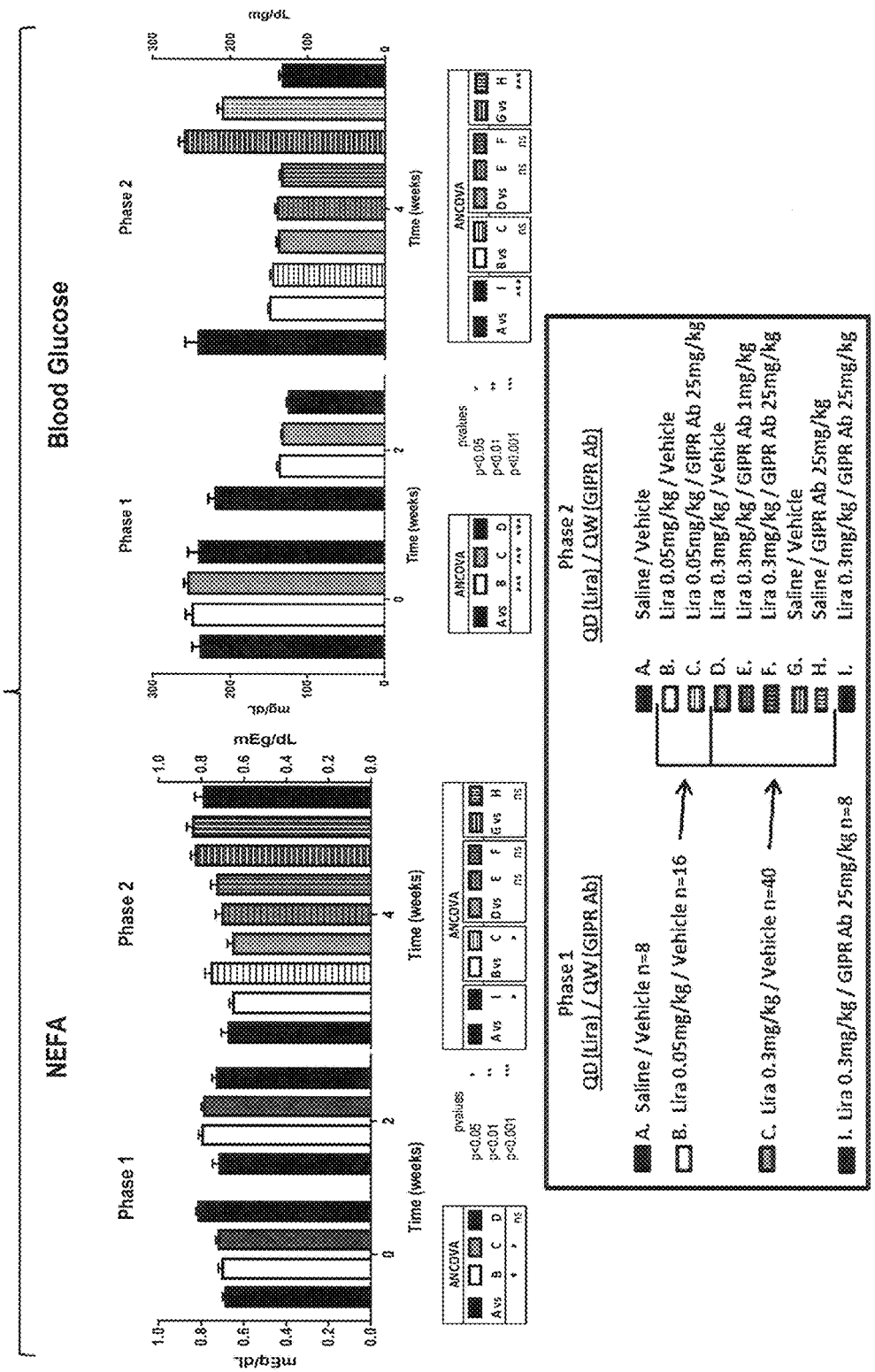

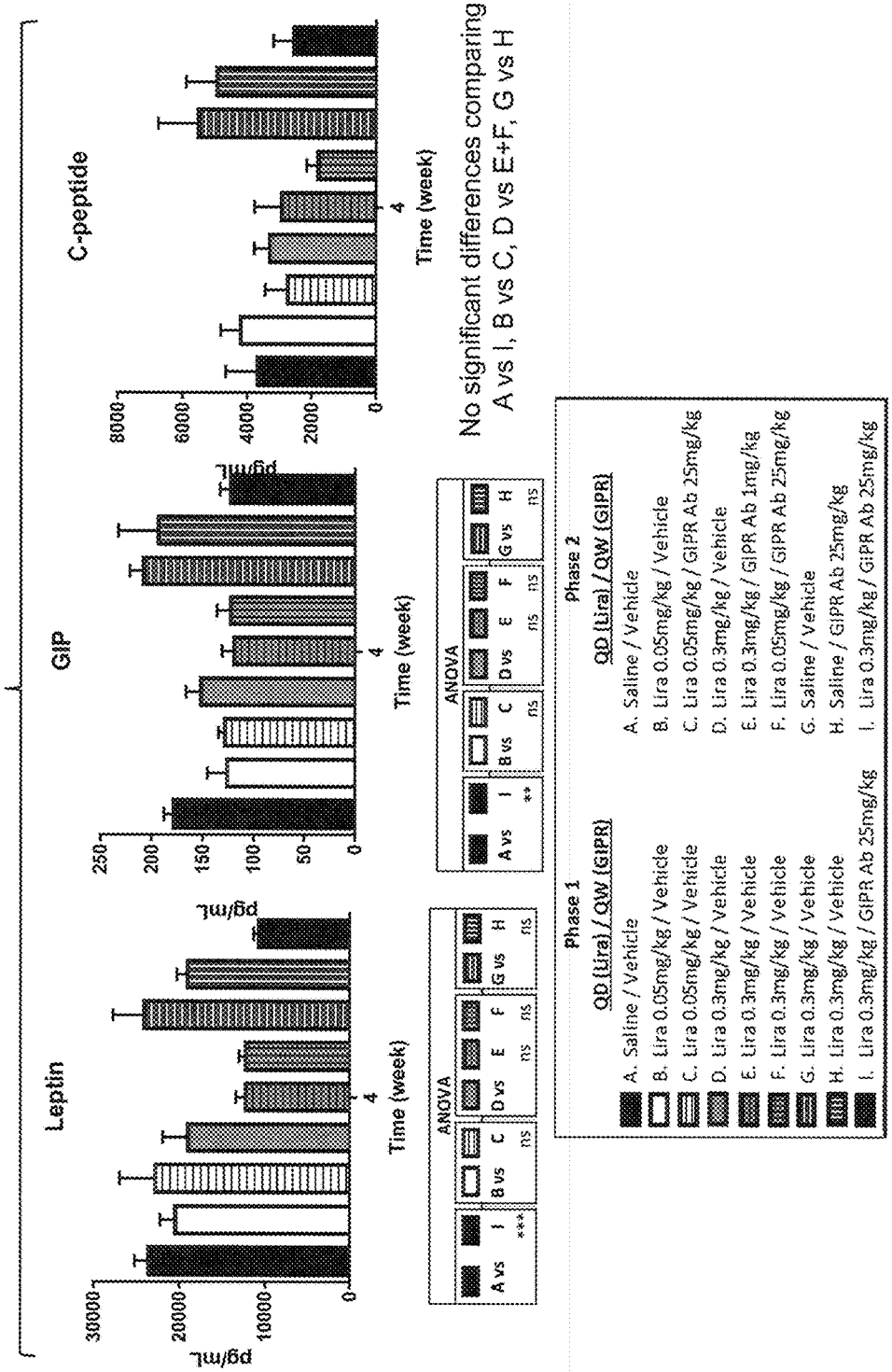

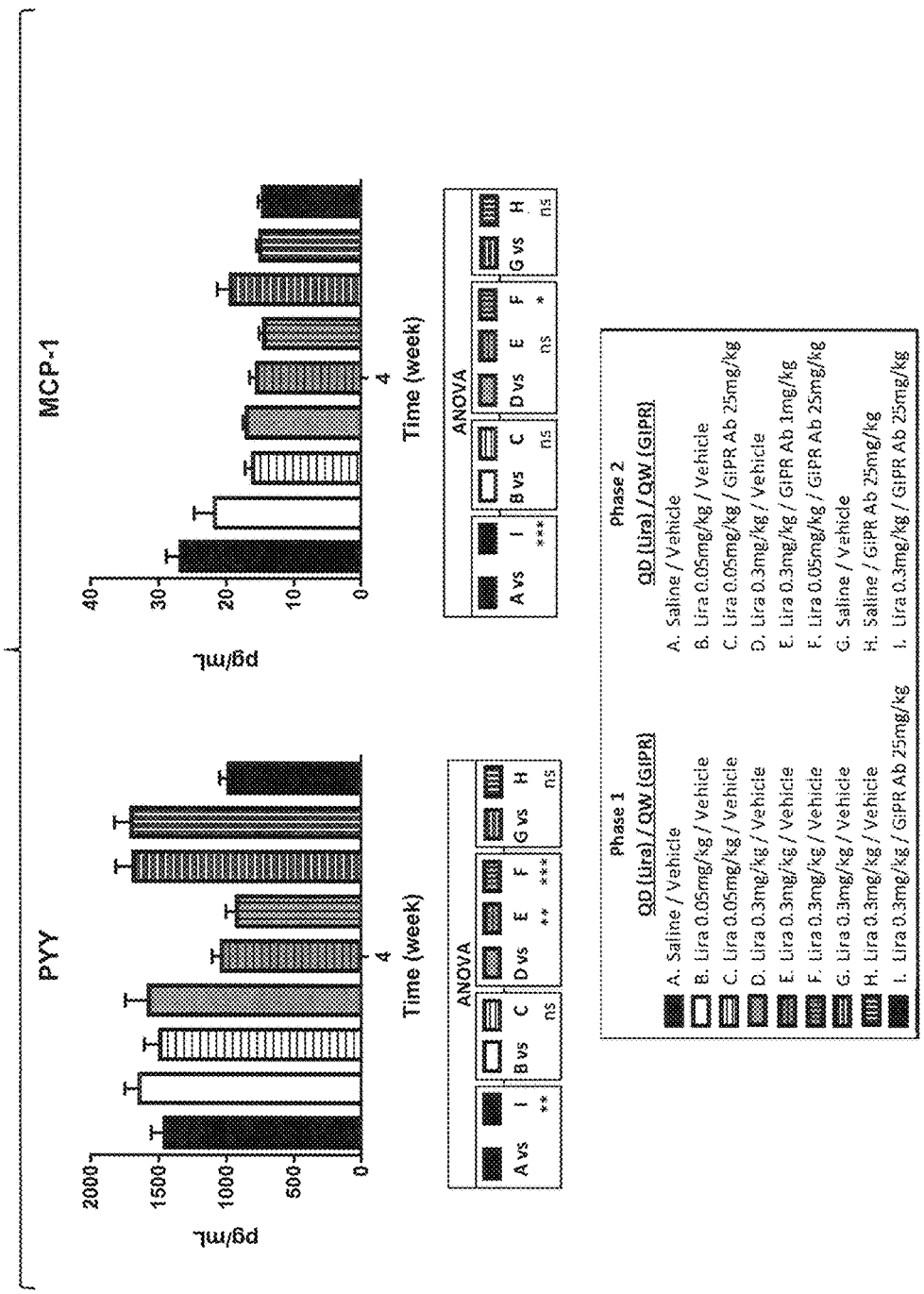

Binding interface highlighting the CDR loops of Fab 2G10

Binding interface highlighting the huGIPR residues

Binding interface highlighting the
CDR loops of Fab 2C2

Binding interface highlighting
the huGIPR residues

Binding interface highlighting the
CDR loops of Fab 6H1

Binding interface highlighting
the huGIPR residues

Binding interface highlighting the
CDR loops of Fab 17H11

Binding interface highlighting
the huGIPR residues

2G10

2C2

6H1

17H11

Epitope for the Gipg013 (PDB: 4JH0)

METHOD OF TREATING OR AMELIORATING METABOLIC DISORDERS USING BINDING PROTEINS FOR GASTRIC INHIBITORY PEPTIDE RECEPTOR (GIPR) IN COMBINATION WITH GLP-1 AGONISTS

FIELD OF THE INVENTION

The present disclosure relates to the treatment or amelioration of a metabolic disorder, such as type 2 diabetes, elevated glucose levels, elevated insulin levels, obesity, non-alcoholic fatty liver disease, or cardiovascular diseases, using an antigen binding protein specific for the gastric inhibitory peptide receptor (GIPR).

BACKGROUND OF THE INVENTION

Glucose-dependent insulinotropic polypeptide (GIP) is a single 42-amino acid peptide secreted from K-cells in the small intestine (duodenum and jejunum). Human GIP is derived from the processing of proGIP, a 153-amino acid precursor that is encoded by a gene localized to chromosome 17q (Inagaki et al., Mol Endocrinol 1989; 3:1014-1021; Fehmann et al. Endocr Rev. 1995; 16:390-410). GIP was formerly called gastric inhibitory polypeptide.

GIP secretion is induced by food ingestion. GIP has a number of physiological effects in tissues, including promotion of fat storage in adipocytes and promotion of pancreatic islet β-cell function and glucose-dependent insulin secretion. GIP and glucagon like polypeptide-1 (GLP-1) are known insulinotropic factors ("incretins"). Intact GIP is rapidly degraded by DPPIV to an inactive form. The insulinotropic effect of GIP is lost in type 2 diabetic patients while GLP-1's incretin effect remains intact (Nauck et al. J. Clinc. Invest. 1993; 91:301-307).

The GIP receptor (GIPR) is a member of the secretin-glucagon family of G-protein coupled receptors (GPCRs) having an extracellular N-terminus, seven transmembrane domains and an intracellular C-terminus. The N-terminal extracellular domains of this family of receptors are usually glycosylated and form the recognition and binding domain of the receptor. GIPR is highly expressed in a number of tissues, including the pancreas, gut, adipose tissue, heart, pituitary, adrenal cortex, and brain (Usdin et al., Endocrinology. 1993, 133:2861-2870). Human GIPR comprises 466 amino acids and is encoded by a gene located on chromosome 19q13.3 (Gremlich et al., Diabetes. 1995; 44:1202-8; Volz et al., FEBS Lett. 1995, 373:23-29). Studies have suggested that alternative mRNA splicing results in the production of GIP receptor variants of differing lengths in human, rat and mouse.

GIPR knockout mice (Gipr$^{-/-}$) are resistant to high fat diet-induced weight gain and have improved insulin sensitivity and lipid profiles. (Yamada et al., Diabetes. 2006, 55:S86; Miyawaki et al. Nature Med. 2002, 8:738-742). In addition, a novel small molecule GIPR antagonist SKL-14959 prevents obesity and insulin resistance. (Diabetologia 2008, 51:S373, 44th EASD Annual meeting poster).

Glucagon-like peptide-1 ("GLP-1") is a 31-amino acid peptide derived from the proglucagon gene. It is secreted by intestinal L-cells and released in response to food ingestion to induce insulin secretion from pancreatic β-cells (Diabetes 2004, 53:S3, 205-214). In addition to the incretin effects, GLP-1 also decreases glucagon secretion, delays gastric emptying and reduces caloric intake (Diabetes Care, 2003, 26(10): 2929-2940). GLP-1 exerts its effects by activation of the GLP-1 receptor, which belongs to a class B G-protein-coupled receptor (Endocrinology. 1993, 133(4):1907-10). The function of GLP-1 is limited by rapid degradation by the DPP-IV enzyme, resulting in a half-life of approximately 2 minutes. Recently, long-lasting GLP-1 receptor agonists such as exenatide, liraglutide, dulaglutide have been developed and are now being used clinically to improve glycemic control in patients with type 2 diabetes. Furthermore, GLP-1 receptor agonists also promote body weight reduction as well as reduction in blood pressure and plasma cholesterol levels in patients (Bioorg. Med. Chem. Lett 2013, 23:4011-4018).

Collectively, these links to obesity and insulin resistance imply GIPR inhibition is a useful approach for therapeutic intervention, both as a monotherapy and in combination with GLP-1.

SUMMARY OF THE INVENTION

In one aspect, the present disclosure provides a method of treating a subject with a metabolic disorder, the method comprising administering to the subject a therapeutically effective amount of an antigen binding protein that specifically binds to a protein having an amino acid sequence having at least 90% amino acid sequence identity to an amino acid sequence of a GIPR. In one aspect the present invention is directed to a method of treating a subject with a metabolic disorder, the method comprising administering to the subject a therapeutically effective amount of a GLP-1 receptor agonist and a therapeutically effective amount of a GIPR antagonist that specifically binds to a protein having an amino acid sequence having at least 90% amino acid sequence identity to an amino acid sequence of a GIPR. In one embodiment, the metabolic disorder is a disorder of glucose metabolism. In another embodiment, the glucose metabolism disorder comprises hyperglycemia and administering the antigen binding protein reduces plasma glucose. In another embodiment, the glucose metabolism disorder comprises hyperinsulinemia and administering the antigen binding protein reduces plasma insulin. In another embodiment, the glucose metabolism disorder comprises glucose intolerance and administering the antigen binding protein reduces increases glucose tolerance. In another embodiment, the glucose metabolism disorder comprises insulin resistance and administering the antigen binding protein reduces insulin resistance. In another embodiment, the glucose metabolism disorder comprises diabetes mellitus. In another embodiment, the subject is obese. In another embodiment, administering the antigen binding protein reduces body weight in an obese subject. In another embodiment, administering the antigen binding protein reduces body weight gain in an obese subject. In another embodiment, administering the antigen binding protein reduces fat mass in an obese subject. In another embodiment, the glucose metabolism disorder comprises insulin resistance and administering the antigen binding protein reduces insulin resistance in an obese subject. In another embodiment, administering the antigen binding protein reduces liver steatosis in an obese subject having increased liver steatosis. In another embodiment, administering the antigen binding protein reduces liver fat content in an obese subject having increased liver fat content.

In one aspect the present invention is directed to a method of treatment comprising administering to a subject a therapeutically effective amount of at least one GLP-1 receptor agonist in combination with administration of at least one GIPR antagonist which upon administration to a subject with symptoms of a metabolic disorder provides sustained beneficial effects.

In one embodiment, administration of at least one GLP-1 receptor agonist in combination with administration of at least one GIPR antagonist provides sustained beneficial effects of at least one symptom of a metabolic disorder.

In one embodiment, the therapeutically effective amounts of the GLP-1 receptor agonist and the GIPR antagonist are combined prior to administration to the subject.

In one embodiment, the therapeutically effective amounts of the GLP-1 receptor agonist and the GIPR antagonist are administered to the subject sequentially.

In one embodiment, the therapeutically effective amounts of a GLP-1 receptor agonist and a GIPR antagonist are synergistically effective amounts.

In one embodiment, the molar ratio of a GLP-1 receptor agonist to a GIPR antagonist is from about 1:1 to 1:110, 1:1 to 1:100, 1:1 to 1:75, 1:1 to 1:50, 1:1 to 1:25, 1:1 to 1:10, 1:1 to 1:5, and 1:1. In one embodiment, the molar ratio of a GIPR antagonist to a GLP-1 receptor agonist is from about 1:1 to 1:110, 1:1 to 1:100, 1:1 to 1:75, 1:1 to 1:50, 1:1 to 1:25, 1:1 to 1:10, and 1:1 to 1:5.

In one embodiment, the GLP-1 receptor agonist is used in combination with the GIPR antagonist at therapeutically effective molar ratios of between about 1:1.5 to 1:150, preferably 1:2 to 1:50.

In one embodiment, the GLP-1 receptor agonist and the GIPR antagonist are present in doses that are at least about 1.1 to 1.4, 1.5, 2, 3, 4, 5, 6, 7, 8, 9, or 10 fold lower than the doses of each compound alone required to treat a condition and/or disease.

In one embodiment, the GLP-1 receptor agonist is GLP-1(7-37) or a GLP-1(7-37) analog.

In one embodiment, the GLP-1 receptor agonist is selected from the group consisting of exenatide, liraglutide, lixisenatide, albiglutide, dulaglutide, semaglutide, and taspoglutide.

In one embodiment, the GLP-1 receptor agonist is selected from the group consisting of GLP-1(7-37) (SEQ ID NO: 3184); GLP-1(7-36)-NH$_2$ (SEQ ID NO: 3185); liraglutide; albiglutide: taspoglutide; dulaglutide, semaglutide; LY2428757; desamino-His$^7$,Arg$^{26}$,Lys$^{34}$(N$^\varepsilon$-(γ-Glu(N-α-hexadecanoyl)))-GLP-1(7-37) (core peptide disclosed as SEQ ID NO: 3222); desamino-His$^7$,Arg$^{26}$,Lys$^{34}$(N$^\varepsilon$-octanoyl)-GLP-1(7-37) (SEQ ID NO: 3223); Arg$^{26,34}$,Lys$^{38}$(N$^\varepsilon$-(ω-carboxypentadecanoyl))-GLP-1(7-38) (SEQ ID NO: 3224); Arg$^{26,34}$,Lys$^{36}$(N$^\varepsilon$-(γ-Glu(N-α-hexadecanoyl)))-GLP-1(7-36) (core peptide disclosed as SEQ ID NO: 3225); Aib$^{8,35}$,Arg$^{26,34}$,Phe$^{31}$-GLP-1(7-36)) (SEQ ID NO: 3186); HXaa$_8$EGTFTSDVSSYLEXaa$_{22}$Xaa$_{23}$AAKEFIXaa$_{30}$WL Xaa$_{33}$Xaa$_{34}$G Xaa$_{36}$Xaa$_{37}$; wherein Xaa$_3$ is A, V, or G; Xaa$_{22}$ is G, K, or E; Xaa$_{23}$ is Q or K; Xaa$_{30}$ is A or E; Xaa$_{33}$ is V or K; Xaa$_{34}$ is K, N, or R; Xaa$_{36}$ is R or G; and Xaa$_{37}$ is G, H, P, or absent (SEQ ID NO: 3187); Arg$^{34}$-GLP-1(7-37) (SEQ ID NO: 3188); Glu$^{30}$-GLP-1(7-37) (SEQ ID NO: 3189); Lys$^{22}$-GLP-1(7-37) (SEQ ID NO: 3190); Gly$^{8,36}$, Glu$^{22}$-GLP-1(7-37) (SEQ ID NO: 3191); Val$^8$,Glu$^{22}$,Gly$^{36}$-GLP-1(7-37) (SEQ ID NO: 3192); Gly$^{8,36}$,Glu$^{22}$,Lys$^{33}$, Asn$^{34}$-GLP-1(7-37) (SEQ ID NO: 3193); Val$^8$,Glu$^{22}$,Lys$^{33}$, Asn$^{34}$,Gly$^{36}$-GLP-1(7-37) (SEQ ID NO: 3194); Gly$^{8,36}$, Glu$^{22}$,Pro$^{37}$-GLP-1(7-37) (SEQ ID NO: 3195); Val$^8$,Glu$^{22}$, Gly$^{36}$Pro$^{37}$-GLP-1(7-37) (SEQ ID NO: 3196); Gly$^{8,36}$, Glu$^{22}$,Lys$^{33}$, Asn$^{34}$,Pro$^{37}$-GLP-1(7-37) (SEQ ID NO: 3197); Val$^8$,Glu$^{22}$,Lys$^{33}$,Asn$^{34}$,Gly$^{36}$,Pro$^{37}$-GLP-1(7-37) (SEQ ID NO: 3198); Gly$^{8,36}$,Glu$^{22}$-GLP-1(7-36) (SEQ ID NO: 3199); Val$^8$,Glu$^{22}$,Gly$^{36}$-GLP-1(7-36) (SEQ ID NO: 3200); Val$^8$,Glu$^{22}$,Asn$^{34}$,Gly$^{36}$-GLP-1(7-36) (SEQ ID NO: 3201); and Gly$^{8,36}$,Glu$^{22}$,Asn$^{34}$-GLP-1(7-36) (SEQ ID NO: 3202).

In another embodiment, the subject is a mammal. In another embodiment, the subject is human. In another embodiment, the GIPR is human GIPR. In another embodiment, the administering is by parenteral injection. In another embodiment, the administering is by subcutaneous injection.

In another aspect the present disclosure provides an antigen binding protein that specifically binds to a human GIPR polypeptide and inhibits activation of GIPR by GIP ligand. In one embodiment, the antigen binding protein inhibits GIP ligand binding to GIPR. In another embodiment, the antigen binding protein is a human antigen binding protein. In another embodiment, the antigen binding protein is a human antibody. In another embodiment, the antigen binding protein is a monoclonal antibody.

In another aspect, the present disclosure provides a pharmaceutical composition comprising at least one antigen binding protein according to any one of the foregoing embodiments.

In another aspect, the present disclosure provides a nucleic acid molecule encoding an antigen binding protein according to any one of the foregoing embodiments.

In another aspect, the present disclosure provides a vector comprising a nucleic acid molecule encoding an antigen binding protein according to any one of the foregoing embodiments.

In another aspect, the present disclosure provides a host cell comprising a nucleic acid molecule encoding an antigen binding protein according to any one of the foregoing embodiments or a vector comprising a nucleic acid molecule encoding an antigen binding protein according to any one of the foregoing embodiments. In another aspect the present disclosure provides an antigen binding protein that specifically binds to a human GIPR polypeptide expressed by the vector.

In another aspect, the present disclosure provides a method of making an antigen binding protein according to any one of the foregoing embodiments, the method comprising expressing the antigen binding protein in a host cell that secretes the antigen binding protein, and then purifying the antigen binding protein from the cell culture media. In another aspect the present disclosure provides an antigen binding protein that specifically binds to a human GIPR polypeptide purified from the host cell.

In another aspect, the present disclosure provides an antigen binding protein of any one of the foregoing embodiments or a pharmaceutical composition of any one of the foregoing embodiments for use in therapy.

BRIEF DESCRIPTION OF THE DRAWINGS

FIG. 1. Mouse Pharmacodynamic Assay To Test GIPR Antibodies—Study Design

FIG. 6. GIPR Antibody 2.63.1 Results In Lower Epididymal White Adipose Tissue Weights FIG. 7A-7D. Fasting Glucose Levels after (FIG. 7A) 2 days, (FIG. 7B) 21 days, (FIG. 7C) 28 days, and (FIG. 7D) 35 days in mice treated with GIPR Antibody 2.63.1

FIG. 14(A) 4H9 antibody family kd [1/s];
FIG. 14(B) 4H9 antibody family IC60 (nM);
FIG. 14(C) 4B1 antibody family kd [1/s];
FIG. 14(D) 4B1 antibody family IC60 (nM);
FIG. 14(E) 18F2 antibody family kd [1/s];
FIG. 14(F) 18F2 antibody family IC60 (nM);
FIG. 14(G) 2F11 antibody family kd [1/s];
FIG. 14(H) 2F11 antibody family IC60 (nM);
FIG. 14(I) 6H1 antibody family kd [1/s];
FIG. 14(J) 6H1 antibody family IC60 (nM);
FIG. 14(K) 6A5 antibody family kd [1/s];
FIG. 14(L) 6A5 antibody family IC60 (nM);
FIG. 14(M) 5G12 antibody family kd [1/s];
FIG. 14(N) 5G12 antibody family IC60 (nM);
FIG. 14(O) 2A11 antibody family kd [1/s];
FIG. 14(P) 2A11 antibody family IC60 (nM);
FIG. 14(Q) 2G10 antibody family kd [1/s];
FIG. 14(R) 2G10 antibody family IC60 (nM);
FIG. 14(S) 17H11 antibody family kd [1/s];
FIG. 14(T) 17H11 antibody family IC60 (nM);
FIG. 14(U) 18E3 antibody family kd [1/s];
FIG. 14(V) 18E3 antibody family IC60 (nM);
FIG. 14(W) 5C2 antibody family kd [1/s];
FIG. 14(X) 5C2 antibody family IC60 (nM);
FIG. 14(Y) 11C1 antibody family kd [1/s];
FIG. 14(Z) 11C1 antibody family IC60 (nM);
FIG. 14(AA) 13H12 antibody family kd [1/s];
FIG. 14(BB) 13H12 antibody family IC60 (nM);
FIG. 14(CC) 12H11 antibody family kd [1/s];
FIG. 14(DD) 12H11 antibody family IC60 (nM);
FIG. 14(EE) 2C2 antibody family kd [1/s];
FIG. 14(FF) 2C2 antibody family IC60 (nM);
FIG. 14(GG) 17B11 antibody family kd [1/s]; and
FIG. 14(HH) 17B11 antibody family IC60 (nM).

FIG. 17A-17B. GIPR Antibody 5G12.006 Antagonized GIP Glucose Levels (FIG. 17A) and Induced Insulin Secretion (FIG. 17B)

FIG. 18. Chronic Treatment Of Diet Induced Obese Mice With GIPR Antibody 5G12.006—Study Design FIG. 19A-19B. GIPR Antibody 5G12.006 Results In Reduced Body Weight Gain: (FIG. 25A) weight (g) and (FIG. 25B) percent change body weight FIG. 26A-26D. Significant Fat Mass Loss In Mice Treated With Anti-GIPR 2.63.1 In Combination With Liraglutide.

(FIG. 31A) day 10, (FIG. 31B) day 22, (FIG. 31C) day 25, and (FIG. 31D) day 39

FIG. 32. Serum Total Cholesterol Levels In Mice Treated With Anti-GIPR 2.63.1 In Combination With Liraglutide FIG. 33. Serum Leptin Level In Mice Treated With Anti-GIPR 2.63.1 In Combination With Liraglutide FIG. 34A-34D. Serum Triglyceride In Mice Treated With Anti-GIPR 2.63.1 In Combination With Liraglutide.

FIG. 35. Study In Mice Treated With Anti-GIPR 2.63.1 In Combination with Liraglutide, Dulaglutide Or Exendin IV FIG. 36A-36B. Body Weight Loss In Mice Treated With Anti-GIPR 2.63.1 In Combination With Liraglutide, Dulaglutide Or Exendin IV.

FIG. 42A-42B. (FIG. 42A) Body Weights—Combined Graphs and (FIG. 42B) Body Weights Separated Graphs. Diet-induced Obese (DIO) mice dosed with combination of 1) daily saline or Liraglutide (Lira), and 2) weekly vehicle or the GIPR Antibody (Ab) and daily percent body weight change was calculated. The study was divided into 2 phases: Phase 1 established percent body weight change in response to two doses of Liraglutide. Phase 2 established percent body weight change of the GIPR Ab in addition to Liraglutide dosed mice from Phase 1. During Phase 1 and 2, a group of mice were simultaneously dosed with Liraglutide and GIPR Ab to establish the maximal percent weight loss.

FIG. 45A-45C. (FIG. 45A) Clinical Chemistry Liver—Enzymes. (FIG. 45B) Clinical Chemistry—Cholesterol and Triglycerides. (FIG. 45C) Clinical Chemistry—NEFA and Glucose. Diet-induced Obese (DIO) mice dosed with combination of 1) daily saline or Liraglutide (Lira), and 2) weekly vehicle or the GIPR Antibody (Ab) and liver enzymes, lipid levels, glucose and non-essential fatty acids were measured for 3 separate periods. The study was divided into 2 phases: Phase 1 established clinical chemistry levels prior to two doses of Liraglutide. Phase 2 established clinical chemistry levels prior to the GIPR Ab in addition to Liraglutide dosed mice from Phase 1 and at the conclusion of Phase 2. During Phase 1 and 2, a group of mice were simultaneously dosed with Liraglutide and GIPR Ab to establish the maximal percent weight loss.

FIG. 47A-47B. (FIG. 47A) Plasma Hormones. (FIG. 47B) Plasma Hormones (cont.). Diet-induced Obese (DIO) mice dosed with combination of 1) daily saline or Liraglutide (Lira), and 2) weekly vehicle or the GIPR Antibody (Ab) and mouse hormone levels were measured from the terminal blood collection. The study was divided into 2 phases: Phase 1 consisted of two doses of Liraglutide. Phase 2 consisted of the GIPR Ab in addition to Liraglutide dosed mice from Phase 1 and at the conclusion of Phase 2. During Phase 1 and 2, a group of mice were simultaneously dosed with Liraglutide and GIPR Ab to establish the maximal percent weight loss.

(FIG. 49A) weight (g) and (FIG. 49B) percent change body weight.

(FIG. 50A) weight (g) and (FIG. 50B) percent change body weight.

(FIG. 53A) glucose (mg/dL), (FIG. 53B) glucose AUC, (FIG. 53C) insulin ng/dL), and (FIG. 53D) insulin AUC.

(FIG. 57A). The two pairs of complexes are packed against each within the asymmetric unit. The Fab 2G10 molecules are shown in cartoon representation and colored in white and cyan or wheat and dark green for their respective light chain and heavy chain combination. The huGIPR domain is shown in magenta and orange cartoon respectively. (FIG. 57B). Close-up view of one huGIPR-Fab 2G10 complex. The molecules are colored as in panel A.

(FIG. 58A). Close-up view of the binding interface highlighting the CDR loops of Fab 2G10. The heavy chain and light chain of Fab 2G10 are shown in cyan and white cartoon. The CDR loops for heavy chain and light chain are colored in the following order: CDR1: red (HC) or light red (LC); CDR2: green (HC) or light green (LC); and CDR3: blue (HC) or light blue (LC). The huGIPR is shown in magenta cartoon. (FIG. 58B). Close-up view of the binding interface highlighting the huGIPR residues. huGIPR is shown in magenta cartoon and the residues that interact with Fab 2G10 are colored in blue.

(FIG. 59A). The two pairs of complexes adopt an anti-parallel conformation in the asymmetric unit. The Fab 2C2 molecules are shown in cartoon representation and colored in white and cyan or wheat and dark green for their respective light chain and heavy chain combination. The huGIPR domain is shown in magenta and orange cartoon. (FIG. 59B). Close-up view of one huGIPR-Fab 2C2 complex. The molecules are colored as in panel A.

(FIG. 60A). Close-up view of the binding interface highlighting the CDR loops of Fab 2C2. The heavy chain and light chain of Fab 2C2 are shown in cyan and white cartoon. The CDR loops for heavy chain and light chain are colored in the following order: CDR1: red (HC) or light red (LC); CDR2: green (HC) or light green (LC); and CDR3: blue (HC) or light blue (LC). The huGIPR is shown in magenta cartoon. (FIG. 60B). Close-up view of the binding interface highlighting the huGIPR residues. huGIPR is shown in magenta cartoon and the residues that interact with Fab 2C2 are colored in blue.

(FIG. 62A). Close-up view of the binding interface highlighting the CDR loops of Fab 6H1. The heavy chain and light chain of Fab 6H1 are shown in cyan and white cartoon. The CDR loops for heavy chain and light chain are colored in the following order: CDR1: red (HC) or light red (LC); CDR2: green (HC) or light green (LC); and CDR3: blue (HC) or light blue (LC). The huGIPR is shown in magenta cartoon. (FIG. 62B). Close-up view of the binding interface highlighting the huGIPR residues. huGIPR is shown in magenta cartoon and the residues that interact with Fab 6H1 are colored in blue.

(FIG. 64A). Close-up view of the binding interface highlighting the CDR loops of Fab 17H11. The heavy chain and light chain of Fab 17H11 are shown in cyan and white cartoon. The CDR loops for heavy chain and light chain are colored in the following order: CDR1: red (HC) or light red (LC); CDR2: green (HC) or light green (LC); and CDR3: blue (HC) or light blue (LC). The huGIPR is shown in magenta cartoon. (FIG. 64B). Close-up view of the binding interface highlighting the huGIPR residues. huGIPR is shown in magenta cartoon and the residues that interact with Fab 17H11 are colored in blue.

(FIG. 65E) Epitope for the Gipg013 (PDB: 4JH0) is highlighted in red.

DETAILED DESCRIPTION OF THE INVENTION

Figure 2A:
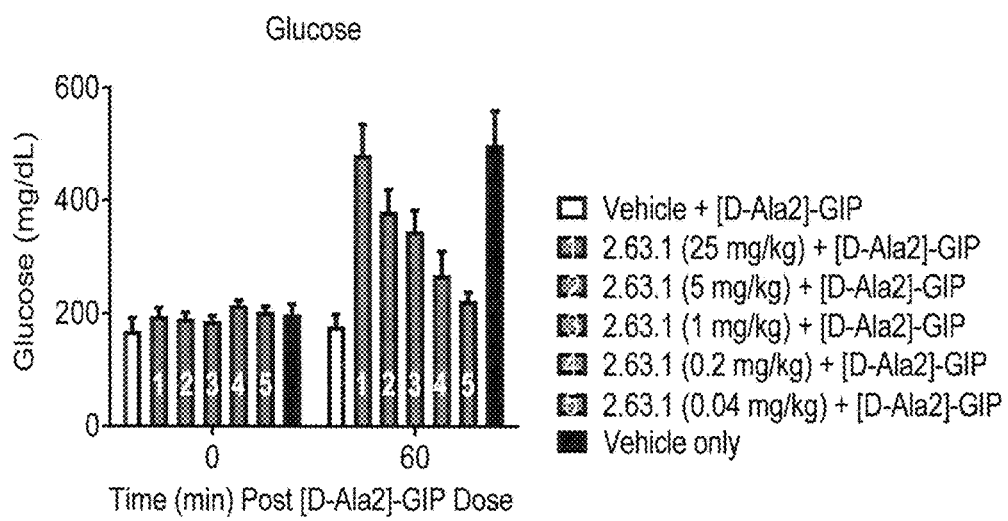
FIG. 2A-2B. GIPR Antibody 2.63.1 Antagonized GIP Induced (FIG. 2A) Glucose Levels and (FIG. 2B) Insulin Secretion FIG. 3. Chronic Treatment Of Diet Induced Obese Mice With GIPR Antibody 2.63.1—Study Design FIG. 4. GIPR Antibody 2.63.1 Treatment Results In Reduced Body Weight Gain FIG. 5A-5D.

The present disclosure provides a method of treating a metabolic disorder, such as a disorder of glucose metabolism (e.g. Type 2 diabetes, elevated glucose levels, elevated insulin levels, dyslipidemia, metabolic syndrome (Syndrome X or insulin resistance syndrome), glucosuria, metabolic acidosis, Type 1 diabetes, obesity and conditions exacerbated by obesity) by blocking or interfering with the biological activity of GIP. In one embodiment, a therapeutically effective amount of an isolated human GIPR binding protein is administered to a subject in need thereof. Methods of administration and delivery are also provided.

Recombinant polypeptide and nucleic acid methods used herein, including in the Examples, are generally those set forth in Sambrook et al., Molecular Cloning: A Laboratory Manual (Cold Spring Harbor Laboratory Press, 1989) or Current Protocols in Molecular Biology (Ausubel et al., eds., Green Publishers Inc. and Wiley and Sons 1994), both of which are incorporated herein by reference for any purpose.

The section headings used herein are for organizational purposes only and are not to be construed as limiting the subject matter described.

Unless otherwise defined herein, scientific and technical terms used in connection with the present application shall have the meanings that are commonly understood by those of ordinary skill in the art. Further, unless otherwise required by context, singular terms shall include pluralities and plural terms shall include the singular.

Generally, nomenclatures used in connection with, and techniques of, cell and tissue culture, molecular biology, immunology, microbiology, genetics and protein and nucleic acid chemistry and hybridization described herein are those well-known and commonly used in the art. The methods and techniques of the present application are generally performed according to conventional methods well known in the art and as described in various general and more specific references that are cited and discussed throughout the present specification unless otherwise indicated. See, e.g., Sambrook et al., Molecular Cloning: A Laboratory Manual, 3rd ed., Cold Spring Harbor Laboratory Press, Cold Spring Harbor, N.Y. (2001), Ausubel et al., Current Protocols in Molecular Biology, Greene Publishing Associates (1992), and Harlow and Lane Antibodies: A Laboratory Manual Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well-known and commonly used in the art. Standard techniques can be used for chemical syntheses, chemical analyses, pharmaceutical preparation, formulation, and delivery, and treatment of patients.

It should be understood that this invention is not limited to the particular methodology, protocols, and reagents, etc., described herein and as such may vary. The terminology used herein is for the purpose of describing particular embodiments only, and is not intended to limit the scope of the disclosed, which is defined solely by the claims.

Other than in the operating examples, or where otherwise indicated, all numbers expressing quantities of ingredients or reaction conditions used herein should be understood as modified in all instances by the term "about." The term "about" when used in connection with percentages may mean ±1%.

Following convention, as used herein "a" and "an" mean "one or more" unless specifically indicated otherwise.

As used herein, the terms "amino acid" and "residue" are interchangeable and, when used in the context of a peptide or polypeptide, refer to both naturally occurring and synthetic amino acids, as well as amino acid analogs, amino acid mimetics and non-naturally occurring amino acids that are chemically similar to the naturally occurring amino acids.

A "naturally occurring amino acid" is an amino acid that is encoded by the genetic code, as well as those amino acids that are encoded by the genetic code that are modified after synthesis, e.g., hydroxyproline, γ-carboxyglutamate, and O-phosphoserine. An amino acid analog is a compound that has the same basic chemical structure as a naturally occurring amino acid, i.e., an a carbon that is bound to a hydrogen, a carboxyl group, an amino group, and an R group, e.g., homoserine, norleucine, methionine sulfoxide, methionine methyl sulfonium. Such analogs can have modified R groups (e.g., norleucine) or modified peptide backbones, but will retain the same basic chemical structure as a naturally occurring amino acid.

An "amino acid mimetic" is a chemical compound that has a structure that is different from the general chemical structure of an amino acid, but that functions in a manner similar to a naturally occurring amino acid. Examples include a methacryloyl or acryloyl derivative of an amide, β-, γ-, δ-amino acids (such as piperidine-4-carboxylic acid) and the like.

A "non-naturally occurring amino acid" is a compound that has the same basic chemical structure as a naturally occurring amino acid, but is not incorporated into a growing polypeptide chain by the translation complex. "Non-naturally occurring amino acid" also includes, but is not limited to, amino acids that occur by modification (e.g., posttranslational modifications) of a naturally encoded amino acid (including but not limited to, the 20 common amino acids) but are not themselves naturally incorporated into a growing polypeptide chain by the translation complex. A non-limiting lists of examples of non-naturally occurring amino acids that can be inserted into a polypeptide sequence or substituted for a wild-type residue in polypeptide sequence include β-amino acids, homoamino acids, cyclic amino acids and amino acids with derivatized side chains. Examples include (in the L-form or D-form; abbreviated as in parentheses): citrulline (Cit), homocitrulline (hCit), Nα-methylcitrulline (NMeCit), Nα-methylhomocitrulline (Nα-MeHoCit), ornithine (Orn), Nα-Methylornithine (Nα-MeOrn or NMeOrn), sarcosine (Sar), homolysine (hLys or hK), homoarginine (hArg or hR), homoglutamine (hQ), Nα-methylarginine (NMeR), Nα-methylleucine (Nα-MeL or NMeL), N-methylhomolysine (NMeHoK), Nα-methyl-glutamine (NMeQ), norleucine (Nle), norvaline (Nva), 1,2,3,4-tetrahydroisoquinoline (Tic), Octahydroindole-2-carboxylic acid (Oic), 3-(1-naphthyl)alanine (1-Nal), 3-(2-naphthyl)alanine (2-Nal), 1,2,3,4-tetrahydroisoquinoline (Tic), 2-indanylglycine (IgI), para-iodophenylalanine (pI-Phe), para-aminophenylalanine (4AmP or 4-Amino-Phe), 4-guanidino phenylalanine (Guf), glycyllysine (abbreviated "K(Nε-glycyl)" or "K(glycyl)" or "K(gly)"), nitrophenyl-alanine (nitrophe), aminophenylalanine (aminophe or Amino-Phe), benzylphenylalanine (benzylphe), γ-carboxy-glutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Nα-methylnorleucine (NMeNle), cyclopentyl-glycine (Cpg), cyclohexylglycine (Chg), acetylarginine (acetylarg), α,β-diaminopropionoic acid (Dpr), α,γ-diamin-obutyric acid (Dab), diaminopropionic acid (Dap), cyclo-hexylalanine (Cha), 4-methyl-phenylalanine (MePhe), β,β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopro-pionic acid, piperidinic acid, aminocaprioic acid, aminohep-tanoic acid, aminopimelic acid, desmosine, diaminopimelic acid, N-ethylglycine, N-ethylaspargine, hydroxylysine, allo-hydroxylysine, isodesmosine, allo-isoleucine, N-methylgly-cine, N-methylisoleucine, N-methylvaline, 4-hydroxypro-line (Hyp), γ-carboxyglutamate, ε-N,N,N-trimethyllysine, ε-N-acetyllysine, O-phosphoserine, N-acetylserine, N-form-ylmethionine, 3-methylhistidine, 5-hydroxylysine, w-meth-ylarginine, 4-Amino-O-Phthalic Acid (4APA), and other similar amino acids, and derivatized forms of any of those specifically listed.

The term "isolated nucleic acid molecule" refers to a single or double-stranded polymer of deoxyribonucleotide or ribonucleotide bases read from the 5' to the 3' end (e.g., a GIPR nucleic acid sequence provided herein), or an analog thereof, that has been separated from at least about 50 percent of polypeptides, peptides, lipids, carbohydrates, polynucleotides or other materials with which the nucleic acid is naturally found when total nucleic acid is isolated from the source cells. Preferably, an isolated nucleic acid molecule is substantially free from any other contaminating nucleic acid molecules or other molecules that are found in the natural environment of the nucleic acid that would interfere with its use in polypeptide production or its thera-peutic, diagnostic, prophylactic or research use.

The term "isolated polypeptide" refers to a polypeptide (e.g., a GIPR polypeptide sequence provided herein or an antigen binding protein of the present invention) that has been separated from at least about 50 percent of polypep-tides, peptides, lipids, carbohydrates, polynucleotides, or other materials with which the polypeptide is naturally found when isolated from a source cell. Preferably, the isolated polypeptide is substantially free from any other contaminating polypeptides or other contaminants that are found in its natural environment that would interfere with its therapeutic, diagnostic, prophylactic or research use.

The term "encoding" refers to a polynucleotide sequence encoding one or more amino acids. The term does not require a start or stop codon.

The terms "identical" and percent "identity," in the context of two or more nucleic acids or polypeptide sequences, refer to two or more sequences or subsequences that are the same. "Percent identity" means the percent of identical residues between the amino acids or nucleotides in the compared molecules and is calculated based on the size of the smallest of the molecules being compared. For these calculations, gaps in alignments (if any) can be addressed by a particular mathematical model or computer program (i.e., an "algorithm"). Methods that can be used to calculate the identity of the aligned nucleic acids or polypeptides include those described in Computational Molecular Biology, (Lesk, A. M., ed.), (1988) New York: Oxford University Press; Biocomputing Informatics and Genome Projects, (Smith, D.

W., ed.), 1993, New York: Academic Press; Computer Analysis of Sequence Data, Part I, (Griffin, A. M., and Griffin, H. G., eds.), 1994, New Jersey: Humana Press; von Heinje, G., (1987) Sequence Analysis in Molecular Biology, New York: Academic Press; Sequence Analysis Primer, (Gribskov, M. and Devereux, J., eds.), 1991, New York: M. Stockton Press; and Carillo et al., (1988) SIAM J. Applied Math. 48:1073.

In calculating percent identity, the sequences being compared are aligned in a way that gives the largest match between the sequences. The computer program used to determine percent identity is the GCG program package, which includes GAP (Devereux et al., (1984) Nucl. Acid Res. 12:387; Genetics Computer Group, University of Wisconsin, Madison, Wis.). The computer algorithm GAP is used to align the two polypeptides or polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., (1978) Atlas of Protein Sequence and Structure 5:345-352 for the PAM 250 comparison matrix; Henikoff et al., (1992) Proc. Natl. Acad. Sci. U.S.A. 89:10915-10919 for the BLOSUM 62 comparison matrix) is also used by the algorithm.

Recommended parameters for determining percent identity for polypeptides or nucleotide sequences using the GAP program are the following:

Algorithm: Needleman et al., 1970, J. Mol. Biol. 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences can result in matching of only a short region of the two sequences, and this small aligned region can have very high sequence identity even though there is no significant relationship between the two full-length sequences. Accordingly, the selected alignment method (e.g., the GAP program) can be adjusted if so desired to result in an alignment that spans at least 50 contiguous amino acids of the target polypeptide.

The terms "GIPR polypeptide" and "GIPR protein" are used interchangeably and mean a naturally-occurring wild-type polypeptide expressed in a mammal, such as a human or a mouse, and includes naturally occurring alleles (e.g., naturally occurring allelic forms of human GIPR protein). For purposes of this disclosure, the term "GIPR polypeptide" can be used interchangeably to refer to any full-length GIPR polypeptide, e.g., SEQ ID NO: 3141, which consists of 466 amino acid residues and which is encoded by the nucleotide sequence SEQ ID NO: 3142, or SEQ ID NO: 3143, which consists of 430 amino acid residues and which is encoded by the nucleic acid sequence SEQ ID NO: 3144, or SEQ ID NO: 3145, which consists of 493 amino acid resides and which is encoded by the nucleic acid sequence of SEQ ID NO: 3146, or SEQ ID NO. 3147, which consists of 460 amino acids residues and which is encoded by the nucleic acid sequence of SEQ ID NO: 3148, or SEQ ID NO. 3149, which consists of 230 amino acids residues and which is encoded by the nucleic acid sequence of SEQ ID NO: 3150.

The term "GIPR polypeptide" also encompasses a GIPR polypeptide in which a naturally occurring GIPR polypeptide sequence (e.g., SEQ ID NOs: 3141, 3143 or 3145) has been modified. Such modifications include, but are not limited to, one or more amino acid substitutions, including substitutions with non-naturally occurring amino acids non-naturally-occurring amino acid analogs and amino acid mimetics.

In various embodiments, a GIPR polypeptide comprises an amino acid sequence that is at least about 85 percent identical to a naturally-occurring GIPR polypeptide (e.g., SEQ ID NOs: 3141, 3143 or 3145). In other embodiments, a GIPR polypeptide comprises an amino acid sequence that is at least about 90 percent, or about 95, 96, 97, 98, or 99 percent identical to a naturally-occurring GIPR polypeptide amino acid sequence (e.g., SEQ ID NOs: 3141, 3143 or 3145). Such GIPR polypeptides preferably, but need not, possess at least one activity of a wild-type GIPR polypeptide, such as the ability to bind GIP. The present invention also encompasses nucleic acid molecules encoding such GIPR polypeptide sequences.

The terms "GIPR activity assay" (also referred to as a "GIPR functional assay") means an assay that can be used to measure GIP or a GIP binding protein activity in a cellular setting. In one embodiment, the "activity" (or "functional") assay" can be a cAMP assay in GIPR expressing cells, in which GIP can induce cAMP signal, and the activity of a GIP/GIPR binding protein could be measured in the presence/absence of GIP ligand, in which IC50/EC50 and degree of inhibition/activation can be obtained (Biochemical and Biophysical Research Communications (2002) 290:1420-1426). In another embodiment, the "activity" (or "functional") assay can be an insulin secretion assay in pancreatic beta cells, in which GIP can induce glucose-dependent insulin secretion, and the activity of a GIP/GIPR binding protein could be measured in the presence/absence of GIP ligand, in which IC50/EC50 and degree of inhibition/activation can be obtained (Biochemical and Biophysical Research Communications (2002) 290:1420-1426).

The term "GIPR binding assay" means an assay that can be used to measure binding of GIP to GIPR. In one embodiment, "GIPR binding assay" can be an assay using FMAT or FACS that measures fluorescence-labeled GIP binding to GIPR expression cells, and GIP/GIPR binding protein's activity can be measured for displacing fluorescence-labeled GIP binding to GIPR expression cells. In another embodiment, "GIPR binding assay" can be an assay that measures radioactive-labeled GIP binding to GIPR expression cells, and GIP/GIPR binding protein's activity can be measured for displacing radioactive labeled GIP binding to GIPR expression cells (Biochimica et Biophysica Acta (2001) 1547:143-155).

The terms "GIP", "Gastric inhibitory polypeptide", "glucose-dependent insulinotropic peptide" and "GIP ligand" are used interchangeably and mean a naturally-occurring wild-type polypeptide expressed in a mammal, such as a human or a mouse, and includes naturally occurring alleles (e.g., naturally occurring allelic forms of human GIP protein). For purposes of this disclosure, the term "GIP" can be used interchangeably to refer to any mature GIP polypeptide.

The 42 amino acid sequence of mature human GIP is:

(SEQ ID NO: 3151)
YAEGTFISDY SIAMDKIHQQ DFVNWLLAQK GKKNDWKHNI TQ and is encoded by the DNA sequence:

(SEQ ID NO: 3152)
tatgcggaag gcacctttat tagcgattat agcattgcga tggataaaat tcatcagcag gattttgtga actggctgct ggcgcagaaa ggcaaaaaaa acgattggaa acataacatt acccag.

The 42 amino acid sequence of mature murine GIP is:

(SEQ ID NO: 3153)
YAEGTFISDY SIAMDKIRQQ DFVNWLLAQR GKKSDWKHNI TQ and is encoded by the DNA sequence:

(SEQ ID NO: 3154)
tatgcggaag gcacctttat tagcgattat agcattgcga tggataaaat tcgccagcag gattttgtga actggctgct ggcgcagcgc ggcaaaaaaa gcgattggaa acataacatt acccag.

The 42 amino acid sequence of mature rat GIP is:

(SEQ ID NO: 3155)
YAEGTFISDY SIAMDKIRQQ DFVNWLLAQK GKKNDWKHNL TQ and is encoded by the DNA sequence:

(SEQ ID NO: 3156)
tatgcggaag gcacctttat tagcgattat agcattgcga tggataaaat tcgccagcag gattttgtga actggctgctg gcgcagaaag gcaaaaaaa cgattggaaa cataacctga cccag.

An "antigen binding protein" as used herein means any protein that specifically binds a specified target antigen, such as a GIPR polypeptide (e.g., a human GIPR polypeptide such as provided in SEQ ID NOs: 3141, 3143 or 3145). The term encompasses intact antibodies that comprise at least two full-length heavy chains and two full-length light chains, as well as derivatives, variants, fragments, and mutations thereof. Examples of antibody fragments include Fab, Fab', F(ab')$_2$, and Fv fragments. An antigen binding protein also includes domain antibodies such as nanobodies and scFvs as described further below.

In general, a GIPR antigen binding protein is said to "specifically bind" its target antigen GIPR when the antigen binding protein exhibits essentially background binding to non-GIPR molecules. An antigen binding protein that specifically binds GIPR may, however, cross-react with GIPR polypeptides from different species. Typically, a GIPR antigen binding protein specifically binds human GIPR when the dissociation constant (KD) is $\leq 10^{-7}$ M as measured via a surface plasma resonance technique (e.g., BIACore, GE-Healthcare Uppsala, Sweden) or Kinetic Exclusion Assay (KinExA, Sapidyne, Boise, Id.). A GIPR antigen binding protein specifically binds human GIPR with "high affinity" when the KD is $\leq 5\times 10^{-9}$ M, and with "very high affinity" when the KD is $\leq 5\times 10^{-10}$ M, as measured using methods described.

"Antigen binding region" means a protein, or a portion of a protein, that specifically binds a specified antigen. For example, that portion of an antigen binding protein that contains the amino acid residues that interact with an antigen and confer on the antigen binding protein its specificity and affinity for the antigen is referred to as "antigen binding region." An antigen binding region typically includes one or more "complementary binding regions" ("CDRs") of an immunoglobulin, single-chain immunoglobulin, or camelid antibody. Certain antigen binding regions also include one or more "framework" regions. A "CDR" is an amino acid sequence that contributes to antigen binding specificity and affinity. "Framework" regions can aid in maintaining the proper conformation of the CDRs to promote binding between the antigen binding region and an antigen.

A "recombinant protein", including a recombinant GIPR antigen binding protein, is a protein made using recombinant techniques, i.e., through the expression of a recombinant nucleic acid as described herein. Methods and techniques for the production of recombinant proteins are well known in the art.

The term "antibody" refers to an intact immunoglobulin of any isotype, or a fragment thereof that can compete with the intact antibody for specific binding to the target antigen, and includes, for instance, chimeric, humanized, fully human, and bispecific antibodies. An "antibody" as such is a species of an antigen binding protein. An intact antibody generally will comprise at least two full-length heavy chains and two full-length light chains. Antibodies may be derived solely from a single source, or may be "chimeric," that is, different portions of the antibody may be derived from two different antibodies as described further below. The antigen binding proteins, antibodies, or binding fragments may be produced in hybridomas, by recombinant DNA techniques, or by enzymatic or chemical cleavage of intact antibodies.

The term "light chain" as used with respect to an antibody or fragments thereof includes a full-length light chain and fragments thereof having sufficient variable region sequence to confer binding specificity. A full-length light chain includes a variable region domain, VL, and a constant region domain, CL. The variable region domain of the light chain is at the amino-terminus of the polypeptide. Light chains include kappa chains and lambda chains.

The term "heavy chain" as used with respect to an antibody or fragment thereof includes a full-length heavy chain and fragments thereof having sufficient variable region sequence to confer binding specificity. A full-length heavy chain includes a variable region domain, VH, and three constant region domains, CH1, CH2, and CH3. The VH domain is at the amino-terminus of the polypeptide, and the CH domains are at the carboxyl-terminus, with the CH3 being closest to the carboxy-terminus of the polypeptide. Heavy chains may be of any isotype, including IgG (including IgG1, IgG2, IgG3 and IgG4 subtypes), IgA (including IgA1 and IgA2 subtypes), IgM and IgE.

The term "immunologically functional fragment" (or simply "fragment") of an antibody or immunoglobulin chain (heavy or light chain), as used herein, is an antigen binding protein comprising a portion (regardless of how that portion is obtained or synthesized) of an antibody that lacks at least some of the amino acids present in a full-length chain but which is capable of specifically binding to an antigen. Such fragments are biologically active in that they bind specifically to the target antigen and can compete with other antigen binding proteins, including intact antibodies, for specific binding to a given epitope.

These biologically active fragments may be produced by recombinant DNA techniques, or may be produced by enzymatic or chemical cleavage of antigen binding proteins, including intact antibodies. Immunologically functional immunoglobulin fragments include, but are not limited to, Fab, Fab', and F(ab')$_2$ fragments.

In another embodiment, Fvs, domain antibodies and scFvs, and may be derived from an antibody of the present invention.

It is contemplated further that a functional portion of the antigen binding proteins disclosed herein, for example, one or more CDRs, could be covalently bound to a second protein or to a small molecule to create a therapeutic agent directed to a particular target in the body, possessing bifunctional therapeutic properties, or having a prolonged serum half-life.

A "Fab fragment" is comprised of one light chain and the CH1 and variable regions of one heavy chain. The heavy chain of a Fab molecule cannot form a disulfide bond with another heavy chain molecule.

An "Fc" region contains two heavy chain fragments comprising the CH2 and CH3 domains of an antibody. The two heavy chain fragments are held together by two or more disulfide bonds and by hydrophobic interactions of the CH3 domains.

An "Fab' fragment" contains one light chain and a portion of one heavy chain that contains the VH domain and the CH1 domain and also the region between the CH1 and CH2 domains, such that an interchain disulfide bond can be formed between the two heavy chains of two Fab' fragments to form an F(ab')2 molecule.

An "F(ab')2 fragment" contains two light chains and two heavy chains containing a portion of the constant region between the CH1 and CH2 domains, such that an interchain disulfide bond is formed between the two heavy chains. A F(ab')2 fragment thus is composed of two Fab' fragments that are held together by a disulfide bond between the two heavy chains.

The "Fv region" comprises the variable regions from both the heavy and light chains, but lacks the constant regions.

"Single chain antibodies" or "scFvs" are Fv molecules in which the heavy and light chain variable regions have been connected by a flexible linker to form a single polypeptide chain, which forms an antigen-binding region. scFvs are discussed in detail in International Patent Application Publication No. WO 88/01649 and U.S. Pat. Nos. 4,946,778 and 5,260,203, the disclosures of which are incorporated by reference.

A "domain antibody" or "single chain immunoglobulin" is an immunologically functional immunoglobulin fragment containing only the variable region of a heavy chain or the variable region of a light chain. Examples of domain antibodies include Nanobodies®. In some instances, two or more VH regions are covalently joined with a peptide linker to create a bivalent domain antibody. The two VH regions of a bivalent domain antibody may target the same or different antigens.

A "bivalent antigen binding protein" or "bivalent antibody" comprises two antigen binding regions. In some instances, the two binding regions have the same antigen specificities. Bivalent antigen binding proteins and bivalent antibodies may be bispecific, see, infra.

A multispecific antigen binding protein" or "multispecific antibody" is one that targets more than one antigen or epitope.

A "bispecific," "dual-specific" or "bifunctional" antigen binding protein or antibody is a hybrid antigen binding protein or antibody, respectively, having two different antigen binding sites. Bispecific antigen binding proteins and antibodies are a species of multispecific antigen binding protein or multispecific antibody and may be produced by a variety of methods including, but not limited to, fusion of hybridomas or linking of Fab' fragments. See, e.g., Songsivilai and Lachmann, 1990, Clin. Exp. Immunol. 79:315-321; Kostelny et al., 1992, J. Immunol. 148:1547-1553. The two binding sites of a bispecific antigen binding protein or antibody will bind to two different epitopes, which may reside on the same or different protein targets.

The term "compete" when used in the context of antigen binding proteins (e.g., antibodies) means competition between antigen binding proteins is determined by an assay in which the antigen binding protein (e.g., antibody or immunologically functional fragment thereof) under test prevents or inhibits specific binding of a reference antigen binding protein to a common antigen (e.g., GIPR or a fragment thereof). Numerous types of competitive binding assays can be used, for example: solid phase direct or indirect radioimmunoassay (RIA), solid phase direct or indirect enzyme immunoassay (EIA), sandwich competition assay (see, e.g., Stahli et al., 1983, Methods in Enzymology 9:242-253); solid phase direct biotin-avidin EIA (see, e.g., Kirkland et al., 1986, J. Immunol. 137:3614-3619) solid phase direct labeled assay, solid phase direct labeled sandwich assay (see, e.g., Harlow and Lane, 1988, Antibodies, A Laboratory Manual, Cold Spring Harbor Press); solid phase direct label RIA using I-125 label (see, e.g., Morel et al., 1988, Molec. Immunol. 25:7-15); solid phase direct biotin-avidin EIA (see, e.g., Cheung, et al., 1990, Virology 176: 546-552); and direct labeled RIA (Moldenhauer et al., 1990, Scand. J. Immunol. 32:77-82). Typically, such an assay involves the use of purified antigen bound to a solid surface or cells bearing either of these, an unlabeled test antigen binding protein and a labeled reference antigen binding protein. Competitive inhibition is measured by determining the amount of label bound to the solid surface or cells in the presence of the test antigen binding protein. Usually the test antigen binding protein is present in excess. Additional details regarding methods for determining competitive binding are provided in the examples herein. Usually, when a competing antigen binding protein is present in excess, it will inhibit specific binding of a reference antigen binding protein to a common antigen by at least 40%, 45%, 50%, 55%, 60%, 65%, 70% or 75%. In some instances, binding is inhibited by at least 80%, 85%, 90%, 95%, or 97% or more.

The term "antigen" refers to a molecule or a portion of a molecule capable of being bound by a selective binding agent, such as an antigen binding protein (including, e.g., an antibody), and additionally capable of being used in an animal to produce antibodies capable of binding to that antigen. An antigen may possess one or more epitopes that are capable of interacting with different antigen binding proteins, e.g., antibodies.

The term "epitope" is the portion of a molecule that is bound by an antigen binding protein (for example, an antibody). The term includes any determinant capable of specifically binding to an antigen binding protein, such as an antibody. An epitope can be contiguous or non-contiguous (discontinuous) (e.g., in a polypeptide, amino acid residues that are not contiguous to one another in the polypeptide sequence but that within in context of the molecule are bound by the antigen binding protein). A conformational epitope is an epitope that exists within the conformation of an active protein but is not present in a denatured protein. In certain embodiments, epitopes may be mimetic in that they comprise a three dimensional structure that is similar to an epitope used to generate the antigen binding protein, yet comprise none or only some of the amino acid residues found in that epitope used to generate the antigen binding protein. Most often, epitopes reside on proteins, but in some instances may reside on other kinds of molecules, such as nucleic acids. Epitope determinants may include chemically active surface groupings of molecules such as amino acids, sugar side chains, phosphoryl or sulfonyl groups, and may have specific three dimensional structural characteristics, and/or specific charge characteristics. Generally, antigen binding proteins specific for a particular target antigen will preferentially recognize an epitope on the target antigen in a complex mixture of proteins and/or macromolecules.

As used herein, "substantially pure" means that the described species of molecule is the predominant species present, that is, on a molar basis it is more abundant than any other individual species in the same mixture. In certain embodiments, a substantially pure molecule is a composition wherein the object species comprises at least 50% (on a molar basis) of all macromolecular species present. In other embodiments, a substantially pure composition will comprise at least 80%, 85%, 90%, 95%, 96%, 97%, 98%, or 99% of all macromolecular species present in the composition. In other embodiments, the object species is purified to essential homogeneity wherein contaminating species cannot be detected in the composition by conventional detection methods and thus the composition consists of a single detectable macromolecular species.

The term "treating" refers to any indicia of success in the treatment or amelioration of an injury, pathology or condition, including any objective or subjective parameter such as abatement; remission; diminishing of symptoms or making the injury, pathology or condition more tolerable to the patient; slowing in the rate of degeneration or decline; making the final point of degeneration less debilitating; improving a patient's physical or mental well-being. The treatment or amelioration of symptoms can be based on objective or subjective parameters; including the results of a physical examination, neuropsychiatric exams, and/or a psychiatric evaluation. For example, certain methods presented herein successfully treat cardiovascular disease such as atherosclerosis by decreasing the incidence of cardiovascular disease, causing remission of cardiovascular disease and/or ameliorating a symptom associated with cardiovascular disease.

An "effective amount" is generally an amount sufficient to reduce the severity and/or frequency of symptoms, eliminate the symptoms and/or underlying cause, prevent the occurrence of symptoms and/or their underlying cause, and/or improve or remediate the damage that results from or is associated with the disease state (e.g., diabetes, obesity, dyslipidemia, elevated glucose levels, elevated insulin levels or diabetic nephropathy. In some embodiments, the effective amount is a therapeutically effective amount or a prophylactically effective amount. A "therapeutically effective amount" is an amount sufficient to remedy a disease state (e.g. atherosclerosis) or symptoms, particularly a state or symptoms associated with the disease state, or otherwise prevent, hinder, retard or reverse the progression of the disease state or any other undesirable symptom associated with the disease in any way whatsoever. A "prophylactically effective amount" is an amount of a pharmaceutical composition that, when administered to a subject, will have the intended prophylactic effect, e.g., preventing or delaying the onset (or reoccurrence) of the disease state, or reducing the onset (or reoccurrence) of the disease state, or reducing the likelihood of the onset (or reoccurrence) of the disease state or associated symptoms. The full therapeutic or prophylactic effect does not necessarily occur by administration of one dose, and may occur only after administration of a series of doses. Thus, a therapeutically or prophylactically effective amount may be administered in one or more administrations.

The terms "therapeutically effective dose" and "therapeutically effective amount," as used herein, means an amount of a GIPR binding protein that elicits a biological or medicinal response in a tissue system, animal, or human being sought by a researcher, physician, or other clinician, which includes alleviation or amelioration of the symptoms of the disease or disorder being treated, i.e., an amount of a GIPR binding protein that supports an observable level of one or more desired biological or medicinal response, for example lowering blood glucose, insulin, triglyceride, or cholesterol levels; reducing body weight; or improving glucose tolerance, energy expenditure, or insulin sensitivity.

The term "polynucleotide" or "nucleic acid" includes both single-stranded and double-stranded nucleotide polymers. The nucleotides comprising the polynucleotide can be ribonucleotides or deoxyribonucleotides or a modified form of either type of nucleotide. The modifications include base modifications such as bromouridine and inosine derivatives, ribose modifications such as 2',3'-dideoxyribose, and internucleotide linkage modifications such as phosphorothioate, phosphorodithioate, phosphoroselenoate, phosphorodiselenoate, phosphoroanilothioate, phoshoraniladate and phosphoroamidate.

The term "oligonucleotide" means a polynucleotide comprising 200 or fewer nucleotides. In some embodiments, oligonucleotides are 10 to 60 bases in length. In other embodiments, oligonucleotides are 12, 13, 14, 15, 16, 17, 18, 19, or 20 to 40 nucleotides in length. Oligonucleotides may be single stranded or double stranded, e.g., for use in the construction of a mutant gene. Oligonucleotides may be sense or antisense oligonucleotides. An oligonucleotide can include a label, including a radiolabel, a fluorescent label, a hapten or an antigenic label, for detection assays. Oligonucleotides may be used, for example, as PCR primers, cloning primers or hybridization probes.

An "isolated nucleic acid molecule" means a DNA or RNA of genomic, mRNA, cDNA, or synthetic origin or some combination thereof which is not associated with all or a portion of a polynucleotide in which the isolated polynucleotide is found in nature, or is linked to a polynucleotide to which it is not linked in nature. For purposes of this disclosure, it should be understood that "a nucleic acid molecule comprising" a particular nucleotide sequence does not encompass intact chromosomes. Isolated nucleic acid molecules "comprising" specified nucleic acid sequences may include, in addition to the specified sequences, coding sequences for up to ten or even up to twenty other proteins or portions thereof, or may include operably linked regulatory sequences that control expression of the coding region of the recited nucleic acid sequences, and/or may include vector sequences.

Unless specified otherwise, the left-hand end of any single-stranded polynucleotide sequence discussed herein is the 5' end; the left-hand direction of double-stranded polynucleotide sequences is referred to as the 5' direction. The direction of 5' to 3' addition of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

The term "control sequence" refers to a polynucleotide sequence that can affect the expression and processing of coding sequences to which it is ligated. The nature of such control sequences may depend upon the host organism. In particular embodiments, control sequences for prokaryotes may include a promoter, a ribosomal binding site, and a transcription termination sequence. For example, control sequences for eukaryotes may include promoters comprising one or a plurality of recognition sites for transcription factors, transcription enhancer sequences, and transcription termination sequences. "Control sequences" can include leader sequences and/or fusion partner sequences.

The term "vector" means any molecule or entity (e.g., nucleic acid, plasmid, bacteriophage or virus) used to transfer protein coding information into a host cell.

The term "expression vector" or "expression construct" refers to a vector that is suitable for transformation of a host cell and contains nucleic acid sequences that direct and/or control (in conjunction with the host cell) expression of one or more heterologous coding regions operatively linked thereto. An expression construct may include, but is not limited to, sequences that affect or control transcription, translation, and, if introns are present, affect RNA splicing of a coding region operably linked thereto.

As used herein, "operably linked" means that the components to which the term is applied are in a relationship that allows them to carry out their inherent functions under suitable conditions. For example, a control sequence in a vector that is "operably linked" to a protein coding sequence is ligated thereto so that expression of the protein coding sequence is achieved under conditions compatible with the transcriptional activity of the control sequences.

The term "host cell" means a cell that has been transformed with a nucleic acid sequence and thereby expresses a gene of interest. The term includes the progeny of the parent cell, whether or not the progeny is identical in morphology or in genetic make-up to the original parent cell, so long as the gene of interest is present.

The terms "polypeptide" or "protein" are used interchangeably herein to refer to a polymer of amino acid residues. The terms also apply to amino acid polymers in which one or more amino acid residues is an analog or mimetic of a corresponding naturally occurring amino acid, as well as to naturally occurring amino acid polymers. The terms can also encompass amino acid polymers that have been modified, e.g., by the addition of carbohydrate residues to form glycoproteins, or phosphorylated. Polypeptides and proteins can be produced by a naturally-occurring and non-recombinant cell; or it is produced by a genetically-engineered or recombinant cell, and comprise molecules having the amino acid sequence of the native protein, or molecules having deletions from, additions to, and/or substitutions of one or more amino acids of the native sequence. The terms "polypeptide" and "protein" specifically encompass GIPR antigen binding proteins, antibodies, or sequences that have deletions from, additions to, and/or substitutions of one or more amino acids of an antigen-binding protein. The term "polypeptide fragment" refers to a polypeptide that has an amino-terminal deletion, a carboxyl-terminal deletion, and/or an internal deletion as compared with the full-length protein. Such fragments may also contain modified amino acids as compared with the full-length protein. In certain embodiments, fragments are about five to 500 amino acids long. For example, fragments may be at least 5, 6, 8, 10, 14, 20, 50, 70, 100, 110, 150, 200, 250, 300, 350, 400, or 450 amino acids long. Useful polypeptide fragments include immunologically functional fragments of antibodies, including binding domains.

The term "isolated protein" means that a subject protein (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature. Typically, an "isolated protein" constitutes at least about 5%, at least about 10%, at least about 25%, or at least about 50% of a given sample. Genomic DNA, cDNA, mRNA or other RNA, of synthetic origin, or any combination thereof may encode such an isolated protein. Preferably, the isolated protein is substantially free from proteins or polypeptides or other contaminants that are found in its natural environment that would interfere with its therapeutic, diagnostic, prophylactic, research or other use.

A "variant" of a polypeptide (e.g., an antigen binding protein such as an antibody) comprises an amino acid sequence wherein one or more amino acid residues are inserted into, deleted from and/or substituted into the amino acid sequence relative to another polypeptide sequence. Variants include fusion proteins.

A "derivative" of a polypeptide is a polypeptide (e.g., an antigen binding protein such as an antibody) that has been chemically modified in some manner distinct from insertion, deletion, or substitution variants, e.g., via conjugation to another chemical moiety.

The term "naturally occurring" as used throughout the specification in connection with biological materials such as polypeptides, nucleic acids, host cells, and the like, refers to materials which are found in nature.

A "subject" or "patient" as used herein can be any mammal. In a typical embodiment, the subject or patient is a human.

As disclosed herein, a GIPR polypeptide described by the instant disclosure can be engineered and/or produced using standard molecular biology methodology. In various examples, a nucleic acid sequence encoding a GIPR, which can comprise all or a portion of SEQ ID NOs: 1, 3 or 5, can be isolated and/or amplified from genomic DNA, or cDNA using appropriate oligonucleotide primers. Primers can be designed based on the nucleic and amino acid sequences provided herein according to standard (RT)-PCR amplification techniques. The amplified GIPR nucleic acid can then be cloned into a suitable vector and characterized by DNA sequence analysis.

Oligonucleotides for use as probes in isolating or amplifying all or a portion of the GIPR sequences provided herein can be designed and generated using standard synthetic techniques, e.g., automated DNA synthesis apparatus, or can be isolated from a longer sequence of DNA.

The 466 amino acid sequence of human GIPR is (Volz et al., FEBS Lett. 373:23-29 (1995); NCBI Reference Sequence: NP_0001555):

(SEQ ID NO: 3141)

MTTSPILQLL LRLSLCGLLL QRAETGSKGQ TAGELYQRWE RYRRECQETL

AAAEPPSGLA CNGSFDMYVC WDYAAPNATA RASCPWYLPW HHHVAAGFVL

RQCGSDGQWG LWRDHTQCEN PEKNEAFLDQ RLILERLQVM YTVGYSLSLA

TLLLALLILS LFRRLHCTRN YIHINLFTSF MLRAAAILSR DRLLPRPGPY

LGDQALALWN QALAACRTAQ IVTQYCVGAN YTWLLVEGVY LHSLLVLVGG

SEEGHFRYYL LLGWGAPALF VIPWVIVRYL YENTQCWERN EVKAIWWIIR

TPILMTILIN FLIFIRILGI LLSKLRTRQM RCRDYRLRLA RSTLTLVPLL

GVHEVVFAPV TEEQARGALR FAKLGFEIFL SSFQGFLVSV LYCFINKEVQ

SEIRRGWHHC RLRRSLGEEQ RQLPERAFRA LPSGSGPGEV PTSRGLSSGT

LPGPGNEASR ELESYC and is encoded by the DNA sequence (NCBI Reference Sequence: NM_000164):

(SEQ ID NO: 3142)

ggcagcggtg gcaggggctg caggagcaag tgaccaggag caggactggg gacaggcctg atcgcccctg cacgaaccag acccttcgcc gccctcacga tgactacctc tccgatcctg cagctgctgc tgcggctctc actgtgcggg ctgctgctcc agagggcgga gacaggctct aaggggcaga cggcggggga gctgtaccag cgctgggaac ggtaccgcag ggagtgccag gagaccttgg cagccgcgga accgccttca ggcctcgcct gtaacgggtc cttcgatatg tacgtctgct gggactatgc tgcacccaat gccactgccc gtgcgtcctg cccctggtac ctgccctggc accaccatgt ggctgcaggt ttcgtcctcc gccagtgtgg cagtgatggc caatggggac tttggagaga ccatacacaa tgtgagaacc cagagaagaa tgaggccttt ctggaccaaa ggctcatctt ggagcggttg caggtcatgt acactgtcgg ctactccctg tctctcgcca cactgctgct agccctgctc atcttgagtt tgttcaggcg gctacattgc actagaaact atatccacat caacctgttc acgtctttca tgctgcgagc tgcggccatt ctcagccgag accgtctgct acctcgacct ggcccctacc ttggggacca ggcccttgcg ctgtggaacc aggccctcgc tgcctgccgc acggcccaga tcgtgaccca gtactgcgtg ggtgccaact acacgtggct gctggtggag ggcgtctacc tgcacagtct cctggtgctc gtgggaggct ccgaggaggg ccacttccgc tactacctgc tcctcggctg gggggccccc gcgcttttcg tcattccctg ggtgatcgtc aggtacctgt acgagaacac gcagtgctgg gagcgcaacg aagtcaaggc catttggtgg attatacgga cccccatcct catgaccatc ttgattaatt tcctcatttt tatccgcatt cttggcattc tcctgtccaa gctgaggaca cggcaaatgc gctgccggga ttaccggctg aggctggctc gctccacgct gacgctggtg cccctgctgg gtgtccacga ggtggtgttt gctcccgtga cagaggaaca ggcccggggc gccctgcgct tcgccaagct cggctttgag atcttcctca gctccttcca gggcttcctg gtcagcgtcc tctactgctt catcaacaag gaggtgcagt cggagatccg ccgtggctgg caccactgcc gcctgcgccg cagcctgggc -continued

```
gaggagcaac gccagctccc ggagcgcgcc ttccgggccc tgccctccgg ctccggcccg ggcgaggtcc ccaccagccg cggcttgtcc tcggggaccc tcccagggcc tgggaatgag gccagccggg agttggaaag ttactgctag ggggcgggat ccccgtgtct gttcagttag catggattta ttgagtgcca actgcgtgcc aggcccagta cggaggacgc tggggaaatg gtgaaggaaa cagaaaaaag gtccctgccc ttctggagat gacaactgag tggggaaaac agaccgtgaa cacaaaacat caagttccac acacgctatg gaatggttat gaagggaagc gagaaggggg cctagggtgg tctgggaggc gtctccaagg aggtgacact taagccatcc ccgaaagagg tgaaagagat cactttgggg agagctggag aacaggattc taggcggaag cgatagcata ggcaaaggcc cttgggcagg aaggcgctca gccttggctg gagtagaatt aagtcagagc caacaggtgg ggagagacag agaagtgggc aggggcaccc aagttgggat ttcatttcag gtgcattgga gattcttagg agtgtctctt ggggtaata ttttatttt taaaaatga ggat.
```

A 430 amino acid isoform of human GIPR (isoform X1), predicted by automated computational analysis, has the sequence (NCBI Reference Sequence XP_005258790):

(SEQ ID NO: 3143)

```
MTTSPILQLL LRLSLCGLLL QRAETGSKGQ TAGELYQRWE RYRRECQETL

AAAEPPSVAA GFVLRQCGSD GQWGLWRDHT QCENPEKNEA FLDQRLILER

LQVMYTVGYS LSLATLLLAL LILSLFRRLH CTRNYIHINL FTSFMLRAAA

ILSRDRLLPR PGPYLGDQAL ALWNQALAAC RTAQIVTQYC VGANYTWLLV

EGVYLHSLLV LVGGSEEGHF RYYLLLGWGA PALFVIPWVI VRYLYENTQC

WERNEVKAIW WIIRTPILMT ILINFLIFIR ILGILLSKLR TRQMRCRDYR

LRLARSTLTL VPLLGVHEVV FAPVTEEQAR GALRFAKLGF EIFLSSFQGF

LVSVLYCFIN KEVQSEIRRG WHHCRLRRSL GEEQRQLPER AFRALPSGSG

PGEVPTSRGL SSGTLPGPGN EASRELESYC
``` and is encoded by the DNA sequence:

(SEQ ID NO: 3144)

```
atgaccacca gcccgattct gcagctgctg ctgcgcctga gcctgtgcgg cctgctgctg cagcgcgcgg aaaccggcag caaaggccag accgcgggcg aactgtatca gcgctgggaa cgctatcgcc gcgaatgcca ggaaaccctg gcggcggcgg aaccgccgag cgtggcggcg ggctttgtgc tgcgccagtg cggcagcgat ggccagtggg gcctgtggcg cgatcatacc cagtgcgaaa acccggaaaa aaacgaagcg tttctggatc agcgcctgat tctggaacgc ctgcaggtga tgtataccgt gggctatagc ctgagcctgg cgaccctgct gctggcgctg ctgattctga gcctgtttcg ccgcctgcat tgcacccgca actatattca tattaacctg tttaccagct ttatgctgcg cgcggcggcg attctgagcc gcgatcgcct gctgccgcgc ccggcccgt atctgggcga tcaggcgctg gcgctgtgga accaggcgct ggcggcgtgc cgcaccgcgc agattgtgac ccagtattgc gtgggcgcga actatacctg gctgctggtg gaaggcgtgt atctgcatag cctgctggtg ctggtgggcg gcagcgaaga aggccatttt cgctattatc tgctgctggg ctggggcgcg ccggcgctgt ttgtgattcc gtgggtgatt gtgcgctatc tgtatgaaaa cacccagtgc
```

-continued

```
tgggaacgca acgaagtgaa agcgatttgg tggattattc gcaccccgat tctgatgacc attctgatta actttctgat ttttattcgc attctgggca ttctgctgag caaactgcgc acccgccaga tgcgctgccg cgattatcgc ctgcgcctgg cgcgcagcac cctgaccctg gtgccgctgc tgggcgtgca tgaagtggtg tttgcgccgg tgaccgaaga acaggcgcgc ggcgcgctgc gctttgcgaa actgggcttt gaaattttc tgagcagctt tcagggcttt ctggtgagcg tgctgtattg ctttattaac aaagaagtgc agagcgaaat tcgccgcggc tggcatcatt gccgcctgcg ccgcagcctg ggcgaagaac agcgccagct gccggaacgc gcgtttcgcg cgctgccgag cggcagcggc ccgggcgaag tgccgaccag ccgcggcctg agcagcggca ccctgccggg cccgggcaac gaagcgagcc gcgaactgga aagctattgc.
```

A 493 amino acid isoform of human GIPR, produced by alternative splicing has the sequence (Gremlich et al., Diabetes 44:1202-8 (1995); UniProtKB Sequence Identifier: P48546-2):

(SEQ ID NO: 3145)

```
AAAEPPSGLA CNGSFDMYVC WDYAAPNATA RASCPWYLPW HHHVAAGFVL

RQCGSDGQWG LWRDHTQCEN PEKNEAFLDQ RLILERLQVM YTVGYSLSLA

TLLLALLILS LFRRLHCTRN YIHINLFTSF MLRAAAILSR DRLLPRPGPY

LGDQALALWN QALAACRTAQ IVTQYCVGAN YTWLLVEGVY LHSLLVLVGG

SEEGHFRYYL LLGWGAPALF VIPWVIVRYL YENTQCWERN EVKAIWWIIR

TPILMTILIN FLIFIRILGI LLSKLRTRQM RCRDYRLRLA RSTLTLVPLL

GVHEVVFAPV TEEQARGALR FAKLGFEIFL SSFQGFLVSV LYCFINKEVG

RDPAAAPALW RRRGTAPPLS AIVSQVQSEI RRGWHHCRLR RSLGEEQRQL

PERAFRALPS GSGPGEVPTS RGLSSGTLPG PGNEASRELE SYC
``` and is encoded by the DNA sequence:

(SEQ ID NO: 3146)

```
cctgctgctg cagcgcgcgg aaaccggcag caaaggccag accgcgggcg aactgtatca gcgctgggaa cgctatcgcc gcgaatgcca ggaaaccctg gcggcggcgg aaccgccgag cggcctggcg tgcaacggca gctttgatat gtatgtgtgc tgggattatg cggcgccgaa cgcgaccgcg cgcgcgagct gcccgtggta tctgccgtgg catcatcatg tggcggcggg cttttgtgctg cgccagtgcg gcagcgatgg ccagtggggc ctgtggcgcg atcataccca gtgcgaaaac ccggaaaaaa acgaagcgtt tctggatcag cgcctgattc tggaacgcct gcaggtgatg tataccgtgg gctatagcct gagcctggcg accctgctgc tggcgctgct gattctgagc ctgtttcgcc gcctgcattg cacccgcaac tatattcata ttaacctgtt taccagcttt atgctgcgcg cggcggcgat tctgagccgc gatcgcctgc tgccgcgccc gggcccgtat ctgggcgatc aggcgctggc gctgtggaac caggcgctgg cggcgtgccg caccgcgcag attgtgaccc agtattgcgt gggcgcgaac tatacctggc tgctggtgga aggcgtgtat ctgcatagcc tgctggtgct ggtgggcggc agcgaagaag gccattttcg ctattatctg ctgctgggct ggggcgcgcc ggcgctgttt gtgattccgt gggtgattgt gcgctatctg tatgaaaaca cccagtgctg ggaacgcaac gaagtgaaag cgatttggtg gattattcgc
```

-continued

```
accccgattc tgatgaccat tctgattaac tttctgattt ttattcgcat tctgggcatt ctgctgagca aactgcgcac ccgccagatg cgctgccgcg attatcgcct gcgcctggcg cgcagcaccc tgaccctggt gccgctgctg ggcgtgcatg aagtggtgtt tgcgccggtg accgaagaac aggcgcgcgg cgcgctgcgc tttgcgaaac tgggcttttga aattttctg agcagctttc agggctttct ggtgagcgtg ctgtattgct ttattaacaa agaagtgggc cgcgatccgg cggcggcgcc ggcgctgtgg cgccgccgcg gcaccgcgcc gccgctgagc gcgattgtga gccaggtgca gagcgaaatt cgccgcggct ggcatcattg ccgcctgcgc cgcagcctgg gcgaagaaca gcgccagctg ccggaacgcg cgtttcgcgc gctgccgagc ggcagcggcc cgggcgaagt gccgaccagc cgcggcctga gcagcggcac cctgccgggc ccgggcaacg aagcgagccg cgaactggaa agctattgct aa
```

A 460 amino acid sequence of murine GIPR is (NCBI Reference Sequence: NP_001074284; uniprotKB/Swiss-Prot Q0P543-1); see Vassilatis et al., PNAS USA 2003, 100:4903-4908.

(SEQ ID NO: 3147)

```
MPLRLLLLLL WLWGLQWAET DSEGQTTTGE LYQRWEHYGQ ECQKMLETTE

PPSGLACNGS FDMYACWNYT AANTTARVSC PWYLPWFRQV SAGFVFRQCG

SDGQWGSWRD HTQCENPEKN GAFQDQTLIL ERLQIMYTVG YSLSLTTLLL

ALLILSLFRR LHCTRNYIHM NLFTSFMLRA AAILTRDQLL PPLGPYTGDQ

APTPWNQALA ACRTAQIMTQ YCVGANYTWL LVEGVYLHHL LVIVGRSEKG

HFRCYLLLGW GAPALFVIPW VIVRYLRENT QCWERNEVKA IWWIIRTPIL

ITILINFLIF IRILGILVSK LRTRQMRCPD YRLRLARSTL TLVPLLGVHE

VVFAPVTEEQ VEGSLRFAKL AFEIFLSSFQ GFLVSVLYCFINKEVQSEIRQ

GWRHRRLRLS LQEQRPRPHQ ELAPRAVPLS SACREAAVGN ALPSGMLHVP

GDEVLESYC
``` and is encoded by the DNA sequence (NCBI Reference Sequence: NM_001080815):

(SEQ ID NO: 3148)

```
atgccgctgc gcctgctgct gctgctgctg tggctgtggg gcctgcagtg ggcggaaacc gatagcgaag gccagaccac caccggcgaa ctgtatcagc gctgggaaca ttatggccag gaatgccaga aaatgctgga aaccaccgaa ccgccgagcg gcctggcgtg caacggcagc tttgatatgt atgcgtgctg gaactatacc gcggcgaaca ccaccgcgcg cgtgagctgc ccgtggtatc tgccgtggtt tcgccaggtg agcgcgggct tgtgtttcg ccagtgcggc agcgatggcc agtggggcag ctggcgcgat catacccagt gcgaaaaccc ggaaaaaaac ggcgcgtttc aggatcagac cctgattctg gaacgcctgc agattatgta taccgtgggc atagcctga gcctgaccac cctgctgctg gcgctgctga ttctgagcct gtttcgccgc ctgcattgca cccgcaacta tattcatatg aacctgtttta ccagctttat gctgcgcgcg cggcgattc tgacccgcga tcagctgctg ccgccgctgg gcccgtatac cggcgatcag gcgccgaccc cgtggaacca ggcgctggcg gcgtgccgca ccgcgcagat tatgacccag tattgcgtgg gcgcgaacta tacctggctg ctggtggaag gcgtgtatct gcatcatctg ctggtgattg tgggccgcag cgaaaaaggc
```

-continued
```
cattttcgct gctatctgct gctgggctgg ggcgcgccgg cgctgtttgt gattccgtgg gtgattgtgc gctatctgcg cgaaaacacc cagtgctggg aacgcaacga agtgaaagcg atttggtgga ttattcgcac cccgattctg attaccattc tgattaactt tctgattttt attcgcattc tgggcattct ggtgagcaaa ctgcgcaccc gccagatgcg ctgcccggat tatcgcctgc gcctggcgcg cagcaccctg accctggtgc cgctgctggg cgtgcatgaa gtggtgtttg cgccggtgac cgaagaacag gtggaaggca gcctgcgctt tgcgaaactg gcgtttgaaa tttttctgag cagctttcag ggctttctgg tgagcgtgct gtattgcttt attaacaaag aagtgcagag cgaaattcgc cagggctggc gccatcgccg cctgcgcctg agcctgcagg aacagcgccc gcgcccgcat caggaactgg cgccgcgcgc ggtgccgctg agcagcgcgt gccgcgaagc ggcggtgggc aacgcgctgc cgagcggcat gctgcatgtg ccgggcgatg aagtgctgga aagctattgc taa
```

A 230 amino acid isoform of murine GIPR, produced by alternative splicing, has the sequence (Gerhard et al., Genome Res, 14:2121-2127 (2004); NCBI Reference Sequence: AAI20674):

(SEQ ID NO: 3149)
```
MPLRLLLLLL WLWGLQWAET DSEGQTTTGE LYQRWEHYGQ ECQKMLETTE

PPSGLACNGS FDMYACWNYT AANTTARVSC PWYLPWFRQV SAGFVFRQCG

SDGQWGSWRD HTQCENPEKN GAFQDQTLIL ERLQIMYTVG YSLSLTTLLL

ALLILSLFRR LHCTRNYIHM NLFTSFMLRA AAILTRDQLL PPLGPYTGDQ

APTPWNQVLH RLLPGGTKTF PIYFRTFPHH
``` and is encoded by the DNA sequence:

(SEQ ID NO: 3150)
```
ggcggaaacc gatagcgaag gccagaccac caccggcgaa ctgtatcagc gctgggaaca ttatggccag gaatgccaga aaatgctgga aaccaccgaa ccgccgagcg gcctggcgtg caacggcagc tttgatatgt atgcgtgctg gaactatacc gcggcgaaca ccaccgcgcg cgtgagctgc ccgtggtatc tgccgtggtt tcgccaggtg agcgcgggct ttgtgtttcg ccagtgcggc agcgatggcc agtggggcag ctggcgcgat cacacccagt gcgaaaaccc ggaaaaaaac ggcgcgtttc aggatcagac cctgattctg aacgcctgc agattatgta taccgtgggc tatagcctga gcctgaccac cctgctgctg gcgctgctga ttctgagcct gtttcgccgc ctgcattgca cccgcaacta tattcatatg aacctgtttta ccagctttat gctgcgcgcg gcggcgattc tgacccgcga tcagctgctg ccgccgctgg gcccgtatac cggcgatcag gcgccgaccc cgtggaacca ggtgctgcat cgcctgctgc cgggcggcac caaaaccttt ccgatttatt ttcgcacctt tccgcatcat taa.
```

As stated herein, the term "GIPR polypeptide" encompasses naturally occurring GIPR polypeptide sequences, e.g., human amino acid sequences SEQ ID NOs: 3141, 3143 or 3145. The term "GIPR polypeptide," however, also encompasses polypeptides comprising an amino acid sequence that differs from the amino acid sequence of a naturally occurring GIPR polypeptide sequence, e.g., SEQ ID NOs: 3141, 3143 or 3145, by one or more amino acids, such that the sequence is at least 85% identical to SEQ ID NOs: 3141, 3143 or 3145. GIPR polypeptides can be generated by introducing one or more amino acid substitutions, either conservative or non-conservative and using naturally or non-naturally occurring amino acids, at particular positions of the GIPR polypeptide.

A "conservative amino acid substitution" can involve a substitution of a native amino acid residue (i.e., a residue found in a given position of the wild-type GIPR polypeptide sequence) with a nonnative residue (i.e., a residue that is not found in a given position of the wild-type GIPR polypeptide sequence) such that there is little or no effect on the polarity or charge of the amino acid residue at that position. Conservative amino acid substitutions also encompass non-naturally occurring amino acid residues that are typically incorporated by chemical peptide synthesis rather than by synthesis in biological systems. These include peptidomimetics, and other reversed or inverted forms of amino acid moieties.

Naturally occurring residues can be divided into classes based on common side chain properties:
(1) hydrophobic: norleucine, Met, Ala, Val, Leu, Ile;
(2) neutral hydrophilic: Cys, Ser, Thr;
(3) acidic: Asp, Glu;
(4) basic: Asn, Gln, His, Lys, Arg;
(5) residues that influence chain orientation: Gly, Pro; and
(6) aromatic: Trp, Tyr, Phe.

Additional groups of amino acids can also be formulated using the principles described in, e.g., Creighton (1984) PROTEINS: STRUCTURE AND MOLECULAR PROPERTIES (2d Ed. 1993), W.H. Freeman and Company. In some instances it can be useful to further characterize substitutions based on two or more of such features (e.g., substitution with a "small polar" residue, such as a Thr residue, can represent a highly conservative substitution in an appropriate context).

Conservative substitutions can involve the exchange of a member of one of these classes for another member of the same class. Non-conservative substitutions can involve the exchange of a member of one of these classes for a member from another class.

Synthetic, rare, or modified amino acid residues having known similar physiochemical properties to those of an above-described grouping can be used as a "conservative" substitute for a particular amino acid residue in a sequence. For example, a D-Arg residue may serve as a substitute for a typical L-Arg residue. It also can be the case that a particular substitution can be described in terms of two or more of the above described classes (e.g., a substitution with a small and hydrophobic residue means substituting one amino acid with a residue(s) that is found in both of the above-described classes or other synthetic, rare, or modified residues that are known in the art to have similar physiochemical properties to such residues meeting both definitions).

Nucleic acid sequences encoding a GIPR polypeptide provided herein, including those degenerate to SEQ ID NOs: 3141, 3143 or 3145, and those encoding polypeptide variants of SEQ ID NOs: 3141, 3143 or 3145 form other aspects of the instant disclosure.

In order to express the GIPR nucleic acid sequences provided herein, the appropriate coding sequences, e.g., SEQ ID NOs: 3141, 3143 or 3145, can be cloned into a suitable vector and after introduction in a suitable host, the sequence can be expressed to produce the encoded polypeptide according to standard cloning and expression techniques, which are known in the art (e.g., as described in Sambrook, J., Fritsh, E. F., and Maniatis, T. Molecular Cloning: A Laboratory Manual 2nd, ed., Cold Spring Harbor Laboratory, Cold Spring Harbor Laboratory Press, Cold Spring Harbor, N.Y., 1989). The invention also relates to such vectors comprising a nucleic acid sequence according to the invention.

A "vector" refers to a delivery vehicle that (a) promotes the expression of a polypeptide-encoding nucleic acid sequence; (b) promotes the production of the polypeptide therefrom; (c) promotes the transfection/transformation of target cells therewith; (d) promotes the replication of the nucleic acid sequence; (e) promotes stability of the nucleic acid; (f) promotes detection of the nucleic acid and/or transformed/transfected cells; and/or (g) otherwise imparts advantageous biological and/or physiochemical function to the polypeptide-encoding nucleic acid. A vector can be any suitable vector, including chromosomal, non-chromosomal, and synthetic nucleic acid vectors (a nucleic acid sequence comprising a suitable set of expression control elements). Examples of such vectors include derivatives of SV40, bacterial plasmids, phage DNA, baculovirus, yeast plasmids, vectors derived from combinations of plasmids and phage DNA, and viral nucleic acid (RNA or DNA) vectors.

A recombinant expression vector can be designed for expression of a GIPR protein in prokaryotic (e.g., *E. coli*) or eukaryotic cells (e.g., insect cells, using baculovirus expression vectors, yeast cells, or mammalian cells). In one embodiment the host cell is a mammalian, non-human host cell. Representative host cells include those hosts typically used for cloning and expression, including *Escherichia coli* strains TOP10F', TOP10, DH10B, DH5a, HB101, W3110, BL21(DE3) and BL21 (DE3)pLysS, BLUESCRIPT (Stratagene), mammalian cell lines CHO, CHO-K1, HEK293, 293-EBNA pIN vectors (Van Heeke & Schuster, J. Biol. Chem. 264: 5503-5509 (1989); pET vectors (Novagen, Madison Wis.). Alternatively, the recombinant expression vector can be transcribed and translated in vitro, for example using T7 promoter regulatory sequences and T7 polymerase and an in vitro translation system. Preferably, the vector contains a promoter upstream of the cloning site containing the nucleic acid sequence encoding the polypeptide. Examples of promoters, which can be switched on and off, include the lac promoter, the T7 promoter, the trc promoter, the tac promoter and the trp promoter.

Thus, provided herein are vectors comprising a nucleic acid sequence encoding GIPR that facilitate the expression of recombinant GIPR. In various embodiments, the vectors comprise an operably linked nucleotide sequence which regulates the expression of GIPR. A vector can comprise or be associated with any suitable promoter, enhancer, and other expression-facilitating elements. Examples of such elements include strong expression promoters (e.g., a human CMV IE promoter/enhancer, an RSV promoter, SV40 promoter, SL3-3 promoter, MMTV promoter, or HIV LTR promoter, EF1alpha promoter, CAG promoter), effective poly (A) termination sequences, an origin of replication for plasmid product in *E. coli*, an antibiotic resistance gene as a selectable marker, and/or a convenient cloning site (e.g., a polylinker). Vectors also can comprise an inducible promoter as opposed to a constitutive promoter such as CMV IE. In one aspect, a nucleic acid comprising a sequence encoding a GIPR polypeptide which is operatively linked to a tissue specific promoter which promotes expression of the sequence in a metabolically-relevant tissue, such as liver or pancreatic tissue is provided.

In another aspect of the instant disclosure, host cells comprising the GIPR nucleic acids and vectors disclosed herein are provided. In various embodiments, the vector or nucleic acid is integrated into the host cell genome, which in other embodiments the vector or nucleic acid is extrachromosomal.

Recombinant cells, such as yeast, bacterial (e.g., *E. coli*), and mammalian cells (e.g., immortalized mammalian cells) comprising such a nucleic acid, vector, or combinations of either or both thereof are provided. In various embodiments cells comprising a non-integrated nucleic acid, such as a plasmid, cosmid, phagemid, or linear expression element, which comprises a sequence coding for expression of a GIPR polypeptide, are provided.

A vector comprising a nucleic acid sequence encoding a GIPR polypeptide provided herein can be introduced into a host cell by transformation or by transfection. Methods of transforming a cell with an expression vector are well known.

A GIPR-encoding nucleic acid can be positioned in and/or delivered to a host cell or host animal via a viral vector. Any suitable viral vector can be used in this capacity. A viral vector can comprise any number of viral polynucleotides, alone or in combination with one or more viral proteins, which facilitate delivery, replication, and/or expression of the nucleic acid of the invention in a desired host cell. The viral vector can be a polynucleotide comprising all or part of a viral genome, a viral protein/nucleic acid conjugate, a virus-like particle (VLP), or an intact virus particle comprising viral nucleic acids and a GIPR polypeptide-encoding nucleic acid. A viral particle viral vector can comprise a wild-type viral particle or a modified viral particle. The viral vector can be a vector which requires the presence of another vector or wild-type virus for replication and/or expression (e.g., a viral vector can be a helper-dependent virus), such as an adenoviral vector amplicon. Typically, such viral vectors consist of a wild-type viral particle, or a viral particle modified in its protein and/or nucleic acid content to increase transgene capacity or aid in transfection and/or expression of the nucleic acid (examples of such vectors include the herpes virus/AAV amplicons). Typically, a viral vector is similar to and/or derived from a virus that normally infects humans. Suitable viral vector particles in this respect, include, for example, adenoviral vector particles (including any virus of or derived from a virus of the adenoviridae), adeno-associated viral vector particles (AAV vector particles) or other parvoviruses and parvoviral vector particles, papillomaviral vector particles, flaviviral vectors, alphaviral vectors, herpes viral vectors, pox virus vectors, retroviral vectors, including lentiviral vectors.

A GIPR polypeptide expressed as described herein can be isolated using standard protein purification methods. A GIPR polypeptide can be isolated from a cell in which is it naturally expressed or it can be isolated from a cell that has been engineered to express GIPR, for example a cell that does not naturally express GIPR.

Protein purification methods that can be employed to isolate a GIPR polypeptide, as well as associated materials and reagents, are known in the art. Additional purification methods that may be useful for isolating a GIPR polypeptide can be found in references such as Bootcov M R, 1997, Proc. Natl. Acad. Sci. USA 94:11514-9, Fairlie W D, 2000, Gene 254: 67-76.

Antagonist antigen binding proteins that bind GIPR, including human GIPR (hGIPR) are provided herein. In one embodiment, the human GIPR has the sequence as such as set forth in SEQ ID NO: 3141. In another embodiment, the human GIPR has the sequence as such set forth in SEQ ID NO: 3143. In another embodiment, the human GIPR has the sequence as such set forth in SEQ ID NO: 3145.

The antigen binding proteins provided are polypeptides into which one or more complementary determining regions (CDRs), as described herein, are embedded and/or joined. In some antigen binding proteins, the CDRs are embedded into a "framework" region, which orients the CDR(s) such that the proper antigen binding properties of the CDR(s) are achieved. Certain antigen binding proteins described herein are antibodies or are derived from antibodies. In other antigen binding proteins, the CDR sequences are embedded in a different type of protein scaffold. The various structures are further described below.

The antigen binding proteins that are disclosed herein have a variety of utilities. The antigen binding proteins, for instance, are useful in specific binding assays, affinity purification of GIPR, and in screening assays to identify other antagonists of GIPR activity. Other uses for the antigen binding proteins include, for example, diagnosis of GIPR-associated diseases or conditions and screening assays to determine the presence or absence of GIPR. Given that the antigen binding proteins that are provided are antagonists, the GIPR antigen binding proteins have value in therapeutic methods in which it is useful to reduce weight gain, even while maintaining or increasing food intake, increasing % fat mass and increasing % lean mass, improving glucose tolerance, decreasing insulin levels, decreasing cholesterol and triglyceride levels. Accordingly, the antigen binding proteins have utility in the treatment and prevention of diabetes, e.g., type 2 diabetes, obesity, dyslipidemia, elevated glucose levels or elevated insulin levels.

A variety of selective binding agents useful for modulating the activity of GIPR are provided. These agents include, for instance, antigen binding proteins that contain an antigen binding domain (e.g., scFvs, domain antibodies, and polypeptides with an antigen binding region) and specifically bind to a GIPR polypeptide, in particular human GIPR. Some of the agents, for example, are useful in enhancing the activity of GIPR, and can activate one or more activities associated with GIPR.

In general the antigen binding proteins that are provided typically comprise one or more CDRs as described herein (e.g., 1, 2, 3, 4, 5 or 6). In some instances, the antigen binding protein comprises (a) a polypeptide structure and (b) one or more CDRs that are inserted into and/or joined to the polypeptide structure. The polypeptide structure can take a variety of different forms. For example, it can be, or comprise, the framework of a naturally occurring antibody, or fragment or variant thereof, or may be completely synthetic in nature. Examples of various polypeptide structures are further described below.

In certain embodiments, the polypeptide structure of the antigen binding proteins is an antibody or is derived from an antibody. Accordingly, examples of certain antigen binding proteins that are provided include, but are not limited to, monoclonal antibodies, bispecific antibodies, minibodies, domain antibodies such as Nanobodies®, synthetic antibodies (sometimes referred to herein as "antibody mimetics"), chimeric antibodies, humanized antibodies, human antibodies, antibody fusions, and portions or fragments of each, respectively. In some instances, the antigen binding protein is an immunological fragment of a complete antibody (e.g., a Fab, a Fab', a F(ab')2). In other instances the antigen binding protein is a scFv that uses CDRs from an antibody of the present invention.

The antigen binding proteins as provided herein specifically bind to a human GIPR. In a specific embodiment, the antigen binding protein specifically binds to human GIPR comprising or consisting of the amino acid sequence of SEQ ID NO: 3141. In a specific embodiment, the antigen binding protein specifically binds to human GIPR comprising or consisting of the amino acid sequence of SEQ ID NO: 3143. In a specific embodiment, the antigen binding protein specifically binds to human GIPR comprising or consisting of the amino acid sequence of SEQ ID NO: 3145.

The antigen binding proteins that are provided are antagonists and typically have one, two, three, four, five, six, seven or all eight of the following characteristics:

(a) ability to prevent or reduce binding of GIP to GIPR, where the levels can be measured, for example, by the methods such as radioactive- or fluorescence-labeled ligand binding study, or by the methods described herein (e.g.

cAMP assay or other functional assays). The decrease can be at least 10, 25, 50, 100% or more relative to the pre-treatment levels of SEQ ID NO: 3141, 3143 or 3145 under comparable conditions.

(b) ability to decrease blood glucose;
(c) ability to increase glucose tolerance;
(d) ability to increase insulin sensitivity;
(e) ability to decrease body weight or reduce body weight gain;
(f) ability to decrease fat mass or decrease inflammation in fat tissue;
(g) ability to decrease fasting insulin levels;
(h) ability to decrease circulating cholesterol levels;
(i) ability to decrease circulating triglyceride levels;
(j) ability to decrease liver steatosis or reduce triglyceride level in liver;
(k) ability to decrease AST, ALT, and/or ALP levels.

In one embodiment, a GIPR antigen binding protein has one or more of the following activities:

(a) binds human GIPR such that KD is≤200 nM, is≤150 nM, is≤100 nM, is≤50 nM, is≤10 nM, is≤5 nM, is≤2 nM, or is≤1 nM, e.g., as measured via a surface plasma resonance or kinetic exclusion assay technique.
(b) has a half-life in human serum of at least 3 days;

Some antigen binding proteins that are provided have an on-rate (ka) for GIPR of at least $10^4$/M×seconds, at least $10^5$/M×seconds, or at least $10^6$/M×seconds as measured, for instance, as described below. Certain antigen binding proteins that are provided have a slow dissociation rate or off-rate. Some antigen binding proteins, for instance, have a kd (off-rate) of $1 \times 10^{-2}$ s$^{-1}$, or $1 \times 10^{-3}$ s$^{-1}$, or $1 \times 10^{-4}$ s$^{-1}$, or $1 \times 10^{-5}$ s$^{-1}$. In certain embodiments, the antigen binding protein has a KD (equilibrium binding affinity) of less than 25 pM, 50 pM, 100 pM, 500 pM, 1 nM, 5 nM, 10 nM, 25 nM or 50 nM.

In another aspect, an antigen-binding protein is provided having a half-life of at least one day in vitro or in vivo (e.g., when administered to a human subject). In one embodiment, the antigen binding protein has a half-life of at least three days. In various other embodiments, the antigen binding protein has a half-life of 4, 5, 6, 7, 8, 9, 10, 15, 20, 25, 30, 40, 50, or 60 days or longer. In another embodiment, the antigen binding protein is derivatized or modified such that it has a longer half-life as compared to the underivatized or unmodified antibody. In another embodiment, the antigen binding protein contains point mutations to increase serum half-life. Further details regarding such mutant and derivatized forms are provided below.

Some of the antigen binding proteins that are provided have the structure typically associated with naturally occurring antibodies. The structural units of these antibodies typically comprise one or more tetramers, each composed of two identical couplets of polypeptide chains, though some species of mammals also produce antibodies having only a single heavy chain. In a typical antibody, each pair or couplet includes one full-length "light" chain (in certain embodiments, about 25 kDa) and one full-length "heavy" chain (in certain embodiments, about 50-70 kDa). Each individual immunoglobulin chain is composed of several "immunoglobulin domains", each consisting of roughly 90 to 110 amino acids and expressing a characteristic folding pattern. These domains are the basic units of which antibody polypeptides are composed. The amino-terminal portion of each chain typically includes a variable domain that is responsible for antigen recognition. The carboxy-terminal portion is more conserved evolutionarily than the other end of the chain and is referred to as the "constant region" or "C region". Human light chains generally are classified as kappa and lambda light chains, and each of these contains one variable domain and one constant domain. Heavy chains are typically classified as mu, delta, gamma, alpha, or epsilon chains, and these define the antibody's isotype as IgM, IgD, IgG, IgA, and IgE, respectively. IgG has several subtypes, including, but not limited to, IgG1, IgG2, IgG3, and IgG4. IgM subtypes include IgM, and IgM2. IgA subtypes include IgA1 and IgA2. In humans, the IgA and IgD isotypes contain four heavy chains and four light chains; the IgG and IgE isotypes contain two heavy chains and two light chains; and the IgM isotype contains five heavy chains and five light chains. The heavy chain C region typically comprises one or more domains that may be responsible for effector function. The number of heavy chain constant region domains will depend on the isotype. IgG heavy chains, for example, each contain three C region domains known as CH1, CH2 and CH3. The antibodies that are provided can have any of these isotypes and subtypes. In certain embodiments, the GIPR antibody is of the IgG1, IgG2, or IgG4 subtype. The terms "GIPR antibody" and "anti-GIPR antibody" are used interchangeably throughout this application and figures. Both terms refer to an antibody that binds to GIPR.

In full-length light and heavy chains, the variable and constant regions are joined by a "J" region of about twelve or more amino acids, with the heavy chain also including a "D" region of about ten more amino acids. See, e.g. Fundamental Immunology, 2nd ed., Ch. 7 (Paul, W., ed.) 1989, New York: Raven Press (hereby incorporated by reference in its entirety for all purposes). The variable regions of each light/heavy chain pair typically form the antigen binding site.

For the antibodies provided herein, the variable regions of immunoglobulin chains generally exhibit the same overall structure, comprising relatively conserved framework regions (FR) joined by three hypervariable regions, more often called "complementarity determining regions" or CDRs. The CDRs from the two chains of each heavy chain/light chain pair mentioned above typically are aligned by the framework regions to form a structure that binds specifically with a specific epitope on GIPR. From N-terminal to C-terminal, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, J. Mol. Biol. 196:901-917; Chothia et al., 1989, Nature 342:878-883.

The sequence information for specific antibodies prepared and identified as described in the Examples below is summarized in TABLE 1. Thus, in an embodiment, an antigen binding protein is an antibody with the CDR, variable domain and light and heavy chain sequences as specified in one of the rows of TABLE 1.

SEQ ID NOs have been assigned to variable light chain, variable heavy chain, light chain, heavy chain, CDRL1, CDRL2, CDRL3, CDRH1, CDRH2, and CDRH3 sequences of the antibodies and fragments thereof of the present invention and are shown in TABLE 1. SEQ ID NOs have also been assigned to polynucleotides encoding the variable light chain, variable heavy chain, light chain, heavy chain, CDRL1, CDRL2, CDRL3, CDRH1, CDRH2, and CDRH3 sequences of the antibodies and fragments thereof of the present invention and are shown in TABLE 2. The antigen binding proteins of the present invention can be identified by SEQ ID NO, but also by construct name (e.g., 2C2.005) or identifier number (e.g., iPS:336175). The antigen binding proteins identified in Tables 1-5 below can be grouped into families based on construct name. For example, the "4B1 family" includes the constructs 4B1, 4B1.010, 4B1.011, 4B1.012, 4B1.013, 4B1.014, 4B1.015, and 4B1.016.

The various light chain and heavy chain variable regions provided herein are depicted in TABLE 3. Each of these variable regions may be attached to a heavy or light chain constant regions to form a complete antibody heavy and light chain, respectively. Furthermore, each of the so generated heavy and light chain sequences may be combined to form a complete antibody structure.

Lengthy table referenced here

US10294303-20190521-T00001

Please refer to the end of the specification for access instructions.

Lengthy table referenced here

US10294303-20190521-T00002

Please refer to the end of the specification for access instructions.

Lengthy table referenced here

US10294303-20190521-T00003

Please refer to the end of the specification for access instructions.

Lengthy table referenced here

US10294303-20190521-T00004

Please refer to the end of the specification for access instructions.

Lengthy table referenced here

US10294303-20190521-T00005

Please refer to the end of the specification for access instructions.

Lengthy table referenced here

US10294303-20190521-T00006

Please refer to the end of the specification for access instructions.

In one embodiment the antibody or fragment thereof comprises a light chain variable region comprising a sequence selected from the group consisting of SEQ ID NOs: 1-157. In one embodiment the antibody or fragment thereof comprises a heavy chain variable region comprising a sequence selected from the group consisting of SEQ ID NOs: 158-314. In one embodiment the antibody or fragment thereof comprises a light chain variable region comprising a sequence selected from the group consisting of SEQ ID NOs: 1-157 and a heavy chain variable region comprising a sequence selected from the group consisting of SEQ ID NOs: 158-314. In one embodiment the antibody or fragment thereof comprises a combination of light chain variable region and a heavy chain variable region selected from the group consisting of a light chain variable region comprising SEQ ID NO: 1 and a heavy chain variable region comprising SEQ ID NO: 158; a light chain variable region comprising SEQ ID NO: 2 and a heavy chain variable region comprising SEQ ID NO: 159; a light chain variable region comprising SEQ ID NO: 3 and a heavy chain variable region comprising SEQ ID NO: 160; a light chain variable region comprising SEQ ID NO: 4 and a heavy chain variable region comprising SEQ ID NO: 161; a light chain variable region comprising SEQ ID NO: 5 and a heavy chain variable region comprising SEQ ID NO: 162; a light chain variable region comprising SEQ ID NO: 6 and a heavy chain variable region comprising SEQ ID NO: 163; a light chain variable region comprising SEQ ID NO: 7 and a heavy chain variable region comprising SEQ ID NO: 164; a light chain variable region comprising SEQ ID NO: 8 and a heavy chain variable region comprising SEQ ID NO: 165; a light chain variable region comprising SEQ ID NO: 9 and a heavy chain variable region comprising SEQ ID NO: 166; a light chain variable region comprising SEQ ID NO: 10 and a heavy chain variable region comprising SEQ ID NO: 167; a light chain variable region comprising SEQ ID NO: 11 and a heavy chain variable region comprising SEQ ID NO: 168; a light chain variable region comprising SEQ ID NO: 12 and a heavy chain variable region comprising SEQ ID NO: 169; a light chain variable region comprising SEQ ID NO: 13 and a heavy chain variable region comprising SEQ ID NO: 170; a light chain variable region comprising SEQ ID NO: 14 and a heavy chain variable region comprising SEQ ID NO: 171; a light chain variable region comprising SEQ ID NO: 15 and a heavy chain variable region comprising SEQ ID NO: 172; a light chain variable region comprising SEQ ID NO: 16 and a heavy chain variable region comprising SEQ ID NO: 173; a light chain variable region comprising SEQ ID NO: 17 and a heavy chain variable region comprising SEQ ID NO: 174; a light chain variable region comprising SEQ ID NO: 18 and a heavy chain variable region comprising SEQ ID NO: 175; a light chain variable region comprising SEQ ID NO: 19 and a heavy chain variable region comprising SEQ ID NO: 176; a light chain variable region comprising SEQ ID NO: 20 and a heavy chain variable region comprising SEQ ID NO: 177; a light chain variable region comprising SEQ ID NO: 21 and a heavy chain variable region comprising SEQ ID NO: 178; a light chain variable region comprising SEQ ID NO: 22 and a heavy chain variable region comprising SEQ ID NO: 179; a light chain variable region comprising SEQ ID NO: 23 and a heavy chain variable region comprising SEQ ID NO: 180; a light chain variable region comprising SEQ ID NO: 24 and a heavy chain variable region comprising SEQ ID NO: 181; a light chain variable region comprising SEQ ID NO: 25 and a heavy chain variable region comprising SEQ ID NO: 182; a light chain variable region comprising SEQ ID NO: 26 and a heavy chain variable region comprising SEQ ID NO: 183; a light chain variable region comprising SEQ ID NO: 27 and a heavy chain variable region comprising SEQ ID NO: 184; a light chain variable region comprising SEQ ID NO: 28 and a heavy chain variable region comprising SEQ ID NO: 185; a light chain variable region comprising SEQ ID NO: 29 and a heavy chain variable region comprising SEQ ID NO: 186; a light chain variable region comprising SEQ ID NO: 30 and a heavy chain variable region comprising SEQ ID NO: 187;
a light chain variable region comprising SEQ ID NO: 31 and
a heavy chain variable region comprising SEQ ID NO: 188;
a light chain variable region comprising SEQ ID NO: 32 and
a heavy chain variable region comprising SEQ ID NO: 189;
a light chain variable region comprising SEQ ID NO: 33 and
a heavy chain variable region comprising SEQ ID NO: 190;
a light chain variable region comprising SEQ ID NO: 34 and
a heavy chain variable region comprising SEQ ID NO: 191;
a light chain variable region comprising SEQ ID NO: 35 and
a heavy chain variable region comprising SEQ ID NO: 192;
a light chain variable region comprising SEQ ID NO: 36 and
a heavy chain variable region comprising SEQ ID NO: 193;
a light chain variable region comprising SEQ ID NO: 37 and
a heavy chain variable region comprising SEQ ID NO: 194;
a light chain variable region comprising SEQ ID NO: 38 and
a heavy chain variable region comprising SEQ ID NO: 195;
a light chain variable region comprising SEQ ID NO: 39 and
a heavy chain variable region comprising SEQ ID NO: 196;
a light chain variable region comprising SEQ ID NO: 40 and
a heavy chain variable region comprising SEQ ID NO: 197;
a light chain variable region comprising SEQ ID NO: 41 and
a heavy chain variable region comprising SEQ ID NO: 198;
a light chain variable region comprising SEQ ID NO: 42 and
a heavy chain variable region comprising SEQ ID NO: 199;
a light chain variable region comprising SEQ ID NO: 43 and
a heavy chain variable region comprising SEQ ID NO: 200;
a light chain variable region comprising SEQ ID NO: 44 and
a heavy chain variable region comprising SEQ ID NO: 201;
a light chain variable region comprising SEQ ID NO: 45 and
a heavy chain variable region comprising SEQ ID NO: 202;
a light chain variable region comprising SEQ ID NO: 46 and
a heavy chain variable region comprising SEQ ID NO: 203;
a light chain variable region comprising SEQ ID NO: 47 and
a heavy chain variable region comprising SEQ ID NO: 204;
a light chain variable region comprising SEQ ID NO: 48 and
a heavy chain variable region comprising SEQ ID NO: 205;
a light chain variable region comprising SEQ ID NO: 49 and
a heavy chain variable region comprising SEQ ID NO: 206;
a light chain variable region comprising SEQ ID NO: 50 and
a heavy chain variable region comprising SEQ ID NO: 207;
a light chain variable region comprising SEQ ID NO: 51 and
a heavy chain variable region comprising SEQ ID NO: 208;
a light chain variable region comprising SEQ ID NO: 52 and
a heavy chain variable region comprising SEQ ID NO: 209;
a light chain variable region comprising SEQ ID NO: 53 and
a heavy chain variable region comprising SEQ ID NO: 210;
a light chain variable region comprising SEQ ID NO: 54 and
a heavy chain variable region comprising SEQ ID NO: 211;
a light chain variable region comprising SEQ ID NO: 55 and
a heavy chain variable region comprising SEQ ID NO: 212;
a light chain variable region comprising SEQ ID NO: 56 and
a heavy chain variable region comprising SEQ ID NO: 213;
a light chain variable region comprising SEQ ID NO: 57 and
a heavy chain variable region comprising SEQ ID NO: 214;
a light chain variable region comprising SEQ ID NO: 58 and
a heavy chain variable region comprising SEQ ID NO: 215;
a light chain variable region comprising SEQ ID NO: 59 and
a heavy chain variable region comprising SEQ ID NO: 216;
a light chain variable region comprising SEQ ID NO: 60 and
a heavy chain variable region comprising SEQ ID NO: 217;
a light chain variable region comprising SEQ ID NO: 61 and
a heavy chain variable region comprising SEQ ID NO: 218;
a light chain variable region comprising SEQ ID NO: 62 and
a heavy chain variable region comprising SEQ ID NO: 219;
a light chain variable region comprising SEQ ID NO: 63 and
a heavy chain variable region comprising SEQ ID NO: 220;
a light chain variable region comprising SEQ ID NO: 64 and
a heavy chain variable region comprising SEQ ID NO: 221;
a light chain variable region comprising SEQ ID NO: 65 and
a heavy chain variable region comprising SEQ ID NO: 222;
a light chain variable region comprising SEQ ID NO: 66 and
a heavy chain variable region comprising SEQ ID NO: 223;
a light chain variable region comprising SEQ ID NO: 67 and
a heavy chain variable region comprising SEQ ID NO: 224;
a light chain variable region comprising SEQ ID NO: 68 and
a heavy chain variable region comprising SEQ ID NO: 225;
a light chain variable region comprising SEQ ID NO: 69 and
a heavy chain variable region comprising SEQ ID NO: 226;
a light chain variable region comprising SEQ ID NO: 70 and
a heavy chain variable region comprising SEQ ID NO: 227;
a light chain variable region comprising SEQ ID NO: 71 and
a heavy chain variable region comprising SEQ ID NO: 228;
a light chain variable region comprising SEQ ID NO: 72 and
a heavy chain variable region comprising SEQ ID NO: 229;
a light chain variable region comprising SEQ ID NO: 73 and
a heavy chain variable region comprising SEQ ID NO: 230;
a light chain variable region comprising SEQ ID NO: 74 and
a heavy chain variable region comprising SEQ ID NO: 231;
a light chain variable region comprising SEQ ID NO: 75 and
a heavy chain variable region comprising SEQ ID NO: 232;
a light chain variable region comprising SEQ ID NO: 76 and
a heavy chain variable region comprising SEQ ID NO: 233;
a light chain variable region comprising SEQ ID NO: 77 and
a heavy chain variable region comprising SEQ ID NO: 234;
a light chain variable region comprising SEQ ID NO: 78 and
a heavy chain variable region comprising SEQ ID NO: 235;
a light chain variable region comprising SEQ ID NO: 79 and
a heavy chain variable region comprising SEQ ID NO: 236;
a light chain variable region comprising SEQ ID NO: 80 and
a heavy chain variable region comprising SEQ ID NO: 237;
a light chain variable region comprising SEQ ID NO: 81 and
a heavy chain variable region comprising SEQ ID NO: 238;
a light chain variable region comprising SEQ ID NO: 82 and
a heavy chain variable region comprising SEQ ID NO: 239;
a light chain variable region comprising SEQ ID NO: 83 and
a heavy chain variable region comprising SEQ ID NO: 240;
a light chain variable region comprising SEQ ID NO: 84 and
a heavy chain variable region comprising SEQ ID NO: 241;
a light chain variable region comprising SEQ ID NO: 85 and
a heavy chain variable region comprising SEQ ID NO: 242;
a light chain variable region comprising SEQ ID NO: 86 and
a heavy chain variable region comprising SEQ ID NO: 243;
a light chain variable region comprising SEQ ID NO: 87 and
a heavy chain variable region comprising SEQ ID NO: 244;
a light chain variable region comprising SEQ ID NO: 88 and
a heavy chain variable region comprising SEQ ID NO: 245;
a light chain variable region comprising SEQ ID NO: 89 and
a heavy chain variable region comprising SEQ ID NO: 246;
a light chain variable region comprising SEQ ID NO: 90 and
a heavy chain variable region comprising SEQ ID NO: 247;
a light chain variable region comprising SEQ ID NO: 91 and
a heavy chain variable region comprising SEQ ID NO: 248;
a light chain variable region comprising SEQ ID NO: 92 and
a heavy chain variable region comprising SEQ ID NO: 249;
a light chain variable region comprising SEQ ID NO: 93 and
a heavy chain variable region comprising SEQ ID NO: 250;
a light chain variable region comprising SEQ ID NO: 94 and
a heavy chain variable region comprising SEQ ID NO: 251;
a light chain variable region comprising SEQ ID NO: 95 and
a heavy chain variable region comprising SEQ ID NO: 252;
a light chain variable region comprising SEQ ID NO: 96 and
a heavy chain variable region comprising SEQ ID NO: 253;
a light chain variable region comprising SEQ ID NO: 97 and a heavy chain variable region comprising SEQ ID NO: 254; a light chain variable region comprising SEQ ID NO: 98 and a heavy chain variable region comprising SEQ ID NO: 255; a light chain variable region comprising SEQ ID NO: 99 and a heavy chain variable region comprising SEQ ID NO: 256; a light chain variable region comprising SEQ ID NO: 100 and a heavy chain variable region comprising SEQ ID NO: 257; a light chain variable region comprising SEQ ID NO: 101 and a heavy chain variable region comprising SEQ ID NO: 258; a light chain variable region comprising SEQ ID NO: 102 and a heavy chain variable region comprising SEQ ID NO: 259; a light chain variable region comprising SEQ ID NO: 103 and a heavy chain variable region comprising SEQ ID NO: 260; a light chain variable region comprising SEQ ID NO: 104 and a heavy chain variable region comprising SEQ ID NO: 261; a light chain variable region comprising SEQ ID NO: 105 and a heavy chain variable region comprising SEQ ID NO: 262; a light chain variable region comprising SEQ ID NO: 106 and a heavy chain variable region comprising SEQ ID NO: 263; a light chain variable region comprising SEQ ID NO: 107 and a heavy chain variable region comprising SEQ ID NO: 264; a light chain variable region comprising SEQ ID NO: 108 and a heavy chain variable region comprising SEQ ID NO: 265; a light chain variable region comprising SEQ ID NO: 109 and a heavy chain variable region comprising SEQ ID NO: 266; a light chain variable region comprising SEQ ID NO: 110 and a heavy chain variable region comprising SEQ ID NO: 267; a light chain variable region comprising SEQ ID NO: 111 and a heavy chain variable region comprising SEQ ID NO: 268; a light chain variable region comprising SEQ ID NO: 112 and a heavy chain variable region comprising SEQ ID NO: 269; a light chain variable region comprising SEQ ID NO: 113 and a heavy chain variable region comprising SEQ ID NO: 270; a light chain variable region comprising SEQ ID NO: 114 and a heavy chain variable region comprising SEQ ID NO: 271; a light chain variable region comprising SEQ ID NO: 115 and a heavy chain variable region comprising SEQ ID NO: 272; a light chain variable region comprising SEQ ID NO: 116 and a heavy chain variable region comprising SEQ ID NO: 273; a light chain variable region comprising SEQ ID NO: 117 and a heavy chain variable region comprising SEQ ID NO: 274; a light chain variable region comprising SEQ ID NO: 118 and a heavy chain variable region comprising SEQ ID NO: 275; a light chain variable region comprising SEQ ID NO: 119 and a heavy chain variable region comprising SEQ ID NO: 276; a light chain variable region comprising SEQ ID NO: 120 and a heavy chain variable region comprising SEQ ID NO: 277; a light chain variable region comprising SEQ ID NO: 121 and a heavy chain variable region comprising SEQ ID NO: 278; a light chain variable region comprising SEQ ID NO: 122 and a heavy chain variable region comprising SEQ ID NO: 279; a light chain variable region comprising SEQ ID NO: 123 and a heavy chain variable region comprising SEQ ID NO: 280; a light chain variable region comprising SEQ ID NO: 124 and a heavy chain variable region comprising SEQ ID NO: 281; a light chain variable region comprising SEQ ID NO: 125 and a heavy chain variable region comprising SEQ ID NO: 282; a light chain variable region comprising SEQ ID NO: 126 and a heavy chain variable region comprising SEQ ID NO: 283; a light chain variable region comprising SEQ ID NO: 127 and a heavy chain variable region comprising SEQ ID NO: 284; a light chain variable region comprising SEQ ID NO: 128 and a heavy chain variable region comprising SEQ ID NO: 285; a light chain variable region comprising SEQ ID NO: 129 and a heavy chain variable region comprising SEQ ID NO: 286; a light chain variable region comprising SEQ ID NO: 130 and a heavy chain variable region comprising SEQ ID NO: 287; a light chain variable region comprising SEQ ID NO: 288; a light chain variable region comprising SEQ ID NO: 132 and a heavy chain variable region comprising SEQ ID NO: 289; a light chain variable region comprising SEQ ID NO: 133 and a heavy chain variable region comprising SEQ ID NO: 290; a light chain variable region comprising SEQ ID NO: 134 and a heavy chain variable region comprising SEQ ID NO: 291; a light chain variable region comprising SEQ ID NO: 135 and a heavy chain variable region comprising SEQ ID NO: 292; a light chain variable region comprising SEQ ID NO: 136 and a heavy chain variable region comprising SEQ ID NO: 293; a light chain variable region comprising SEQ ID NO: 137 and a heavy chain variable region comprising SEQ ID NO: 294; a light chain variable region comprising SEQ ID NO: 138 and a heavy chain variable region comprising SEQ ID NO: 295; a light chain variable region comprising SEQ ID NO: 139 and a heavy chain variable region comprising SEQ ID NO: 296; a light chain variable region comprising SEQ ID NO: 140 and a heavy chain variable region comprising SEQ ID NO: 297; a light chain variable region comprising SEQ ID NO: 141 and a heavy chain variable region comprising SEQ ID NO: 298; a light chain variable region comprising SEQ ID NO: 142 and a heavy chain variable region comprising SEQ ID NO: 299; a light chain variable region comprising SEQ ID NO: 143 and a heavy chain variable region comprising SEQ ID NO: 300; a light chain variable region comprising SEQ ID NO: 144 and a heavy chain variable region comprising SEQ ID NO: 301; a light chain variable region comprising SEQ ID NO: 145 and a heavy chain variable region comprising SEQ ID NO: 302; a light chain variable region comprising SEQ ID NO: 146 and a heavy chain variable region comprising SEQ ID NO: 303; a light chain variable region comprising SEQ ID NO: 147 and a heavy chain variable region comprising SEQ ID NO: 304; a light chain variable region comprising SEQ ID NO: 148 and a heavy chain variable region comprising SEQ ID NO: 305; a light chain variable region comprising SEQ ID NO: 149 and a heavy chain variable region comprising SEQ ID NO: 306; a light chain variable region comprising SEQ ID NO: 150 and a heavy chain variable region comprising SEQ ID NO: 307; a light chain variable region comprising SEQ ID NO: 151 and a heavy chain variable region comprising SEQ ID NO: 308; a light chain variable region comprising SEQ ID NO: 152 and a heavy chain variable region comprising SEQ ID NO: 309; a light chain variable region comprising SEQ ID NO: 153 and a heavy chain variable region comprising SEQ ID NO: 310; a light chain variable region comprising SEQ ID NO: 154 and a heavy chain variable region comprising SEQ ID NO: 311; a light chain variable region comprising SEQ ID NO: 155 and a heavy chain variable region comprising SEQ ID NO: 312; a light chain variable region comprising SEQ ID NO: 156 and a heavy chain variable region comprising SEQ ID NO: 313; and a light chain variable region comprising SEQ ID NO: 157 and a heavy chain variable region comprising SEQ ID NO: 314.

In one embodiment the antibody or fragment thereof comprises a light chain variable region encoded by a polynucleotide sequence selected from the group consisting of SEQ ID NOs: 1571-1727. In one embodiment the antibody or fragment thereof comprises a heavy chain variable region encoded by a polynucleotide selected from the group consisting of SEQ ID NOs: 1728-1884. In one embodiment the antibody or fragment thereof comprises a light chain variable region encoded by a polynucleotide sequence selected from the group consisting of SEQ ID NOs: 1571-1727 and a heavy chain variable region encoded by a polynucleotide sequence selected from the group consisting of SEQ ID NOs: 1728-1884. In one embodiment the antibody or fragment thereof comprises a combination of light chain variable region and a heavy chain variable region selected from the group consisting of a light chain variable region encoded by a polynucleotide sequence comprising SEQ ID NO: 1571 and a heavy chain variable region encoded by a polynucleotide sequence comprising SEQ ID NO: 1728; a light chain variable region encoded by a polynucleotide sequence comprising SEQ ID NO: 1572 and a heavy chain variable region encoded by a polynucleotide sequence comprising SEQ ID NO: 1729; a light chain variable region encoded by a polynucleotide sequence comprising SEQ ID NO: 1573 and a heavy chain variable region encoded by a polynucleotide sequence comprising SEQ ID NO: 1730; a light chain variable region encoded by a polynucleotide sequence comprising SEQ ID NO: 1574 and a heavy chain variable region encoded by a polynucleotide sequence comprising SEQ ID NO: 1731; a light chain variable region encoded by a polynucleotide sequence comprising SEQ ID NO: 1575 and a heavy chain variable region encoded by a polynucleotide sequence comprising SEQ ID NO: 1732; a light chain variable region encoded by a polynucleotide sequence comprising SEQ ID NO: 1576 and a heavy chain variable region encoded by a polynucleotide sequence comprising SEQ ID NO: 1733; a light chain variable region encoded by a polynucleotide sequence comprising SEQ ID NO: 1577 and a heavy chain variable region encoded by a polynucleotide sequence comprising SEQ ID NO: 1734; a light chain variable region encoded by a polynucleotide sequence comprising SEQ ID NO: 1578 and a heavy chain variable region encoded by a polynucleotide sequence comprising SEQ ID NO: 1735; a light chain variable region encoded by a polynucleotide sequence comprising SEQ ID NO: 1579 and a heavy chain variable region encoded by a polynucleotide sequence comprising SEQ ID NO: 1736; a light chain variable region encoded by a polynucleotide sequence comprising SEQ ID NO: 1580 and a heavy chain variable region encoded by a polynucleotide sequence comprising SEQ ID NO: 1737; a light chain variable region encoded by a polynucleotide sequence comprising SEQ ID NO: 1581 and a heavy chain variable region encoded by a polynucleotide sequence comprising SEQ ID NO: 1738; a light chain variable region encoded by a polynucleotide sequence comprising SEQ ID NO: 1582 and a heavy chain variable region encoded by a polynucleotide sequence comprising SEQ ID NO: 1739; a light chain variable region encoded by a polynucleotide sequence comprising SEQ ID NO: 1583 and a heavy chain variable region encoded by a polynucleotide sequence comprising SEQ ID NO: 1740; a light chain variable region encoded by a polynucleotide sequence comprising SEQ ID NO: 1584 and a heavy chain variable region encoded by a polynucleotide sequence comprising SEQ ID NO: 1741; a light chain variable region encoded by a polynucleotide sequence comprising SEQ ID NO: 1585 and a heavy chain variable region encoded by a polynucleotide sequence comprising SEQ ID NO: 1742; a light chain variable region encoded by a polynucleotide sequence comprising SEQ ID NO: 1586 and a heavy chain variable region encoded by a polynucleotide sequence comprising SEQ ID NO: 1743; a light chain variable region encoded by a polynucleotide sequence comprising SEQ ID NO: 1587 and a heavy chain variable region encoded by a polynucleotide sequence comprising SEQ ID NO: 1744; a light chain variable region encoded by a polynucleotide sequence comprising SEQ ID NO: 1588 and a heavy chain variable region encoded by a polynucleotide sequence comprising SEQ ID NO: 1745; a light chain variable region encoded by a polynucleotide sequence comprising SEQ ID NO: 1589 and a heavy chain variable region encoded by a polynucleotide sequence comprising SEQ ID NO: 1746; a light chain variable region encoded by a polynucleotide sequence comprising SEQ ID NO: 1590 and a heavy chain variable region encoded by a polynucleotide sequence comprising SEQ ID NO: 1747; a light chain variable region encoded by a polynucleotide sequence comprising SEQ ID NO: 1591 and a heavy chain variable region encoded by a polynucleotide sequence comprising SEQ ID NO: 1748; a light chain variable region encoded by a polynucleotide sequence comprising SEQ ID NO: 1592 and a heavy chain variable region encoded by a polynucleotide sequence comprising SEQ ID NO: 1749; a light chain variable region encoded by a polynucleotide sequence comprising SEQ ID NO: 1593 and a heavy chain variable region encoded by a polynucleotide sequence comprising SEQ ID NO: 1750; a light chain variable region encoded by a polynucleotide sequence comprising SEQ ID NO: 1594 and a heavy chain variable region encoded by a polynucleotide sequence comprising SEQ ID NO: 1751; a light chain variable region encoded by a polynucleotide sequence comprising SEQ ID NO: 1595 and a heavy chain variable region encoded by a polynucleotide sequence comprising SEQ ID NO: 1752; a light chain variable region encoded by a polynucleotide sequence comprising SEQ ID NO: 1596 and a heavy chain variable region encoded by a polynucleotide sequence comprising SEQ ID NO: 1753; a light chain variable region encoded by a polynucleotide sequence comprising SEQ ID NO: 1597 and a heavy chain variable region encoded by a polynucleotide sequence comprising SEQ ID NO: 1754; a light chain variable region encoded by a polynucleotide sequence comprising SEQ ID NO: 1598 and a heavy chain variable region encoded by a polynucleotide sequence comprising SEQ ID NO: 1755; a light chain variable region encoded by a polynucleotide sequence comprising SEQ ID NO: 1599 and a heavy chain variable region encoded by a polynucleotide sequence comprising SEQ ID NO: 1756; a light chain variable region encoded by a polynucleotide sequence comprising SEQ ID NO: 1600 and a heavy chain variable region encoded by a polynucleotide sequence comprising SEQ ID NO: 1757; a light chain variable region encoded by a polynucleotide sequence comprising SEQ ID NO: 1601 and a heavy chain variable region encoded by a polynucleotide sequence comprising SEQ ID NO: 1758; a light chain variable region encoded by a polynucleotide sequence comprising SEQ ID NO: 1602 and a heavy chain variable region encoded by a polynucleotide sequence comprising SEQ ID NO: 1759; a light chain variable region encoded by a polynucleotide sequence comprising SEQ ID NO: 1603 and a heavy chain variable region encoded by a polynucleotide sequence comprising SEQ ID NO: 1760; a light chain variable region encoded by a polynucleotide sequence comprising SEQ ID NO: 1604 and a heavy chain variable region encoded by a polynucleotide sequence comprising SEQ ID NO: 1761; a light chain variable region encoded by a polynucleotide sequence comprising SEQ ID NO: 1605 and a heavy chain variable region encoded by a polynucleotide sequence comprising SEQ ID NO: 1762; a light chain variable region encoded by a polynucleotide sequence comprising SEQ ID NO: 1606 and a heavy chain variable region encoded by a polynucleotide sequence comprising SEQ ID NO: 1763; a light chain variable region encoded by a polynucleotide sequence comprising SEQ ID NO: 1607 and a heavy chain variable region encoded by a polynucleotide sequence comprising SEQ ID NO: 1764; a light chain variable region encoded by a polynucleotide sequence comprising SEQ ID NO: 1608 and a heavy chain variable region encoded by a polynucleotide sequence comprising SEQ ID NO: 1765; a light chain variable region encoded by a polynucleotide sequence comprising SEQ ID NO: 1609 and a heavy chain variable region encoded by a polynucleotide sequence comprising SEQ ID NO: 1766; a light chain variable region encoded by a polynucleotide sequence comprising SEQ ID NO: 1610 and a heavy chain variable region encoded by a polynucleotide sequence comprising SEQ ID NO: 1767; a light chain variable region encoded by a polynucleotide sequence comprising SEQ ID NO: 1611 and a heavy chain variable region encoded by a polynucleotide sequence comprising SEQ ID NO: 1768; a light chain variable region encoded by a polynucleotide sequence comprising SEQ ID NO: 1612 and a heavy chain variable region encoded by a polynucleotide sequence comprising SEQ ID NO: 1769; a light chain variable region encoded by a polynucleotide sequence comprising SEQ ID NO: 1613 and a heavy chain variable region encoded by a polynucleotide sequence comprising SEQ ID NO: 1770; a light chain variable region encoded by a polynucleotide sequence comprising SEQ ID NO: 1614 and a heavy chain variable region encoded by a polynucleotide sequence comprising SEQ ID NO: 1771; a light chain variable region encoded by a polynucleotide sequence comprising SEQ ID NO: 1615 and a heavy chain variable region encoded by a polynucleotide sequence comprising SEQ ID NO: 1772; a light chain variable region encoded by a polynucleotide sequence comprising SEQ ID NO: 1616 and a heavy chain variable region encoded by a polynucleotide sequence comprising SEQ ID NO: 1773; a light chain variable region encoded by a polynucleotide sequence comprising SEQ ID NO: 1617 and a heavy chain variable region encoded by a polynucleotide sequence comprising SEQ ID NO: 1774; a light chain variable region encoded by a polynucleotide sequence comprising SEQ ID NO: 1618 and a heavy chain variable region encoded by a polynucleotide sequence comprising SEQ ID NO: 1775; a light chain variable region encoded by a polynucleotide sequence comprising SEQ ID NO: 1619 and a heavy chain variable region encoded by a polynucleotide sequence comprising SEQ ID NO: 1776; a light chain variable region encoded by a polynucleotide sequence comprising SEQ ID NO: 1620 and a heavy chain variable region encoded by a polynucleotide sequence comprising SEQ ID NO: 1777; a light chain variable region encoded by a polynucleotide sequence comprising SEQ ID NO: 1621 and a heavy chain variable region encoded by a polynucleotide sequence comprising SEQ ID NO: 1778; a light chain variable region encoded by a polynucleotide sequence comprising SEQ ID NO: 1622 and a heavy chain variable region encoded by a polynucleotide sequence comprising SEQ ID NO: 1779; a light chain variable region encoded by a polynucleotide sequence comprising SEQ ID NO: 1623 and a heavy chain variable region encoded by a polynucleotide sequence comprising SEQ ID NO: 1780; a light chain variable region encoded by a polynucleotide sequence comprising SEQ ID NO: 1624 and a heavy chain variable region encoded by a polynucleotide sequence comprising SEQ ID NO: 1781; a light chain variable region encoded by a polynucleotide sequence comprising SEQ ID NO: 1625 and a heavy chain variable region encoded by a polynucleotide sequence comprising SEQ ID NO: 1782; a light chain variable region encoded by a polynucleotide sequence comprising SEQ ID NO: 1626 and a heavy chain variable region encoded by a polynucleotide sequence comprising SEQ ID NO: 1783; a light chain variable region encoded by a polynucleotide sequence comprising SEQ ID NO: 1627 and a heavy chain variable region encoded by a polynucleotide sequence comprising SEQ ID NO: 1784; a light chain variable region encoded by a polynucleotide sequence comprising SEQ ID NO: 1628 and a heavy chain variable region encoded by a polynucleotide sequence comprising SEQ ID NO: 1785; a light chain variable region encoded by a polynucleotide sequence comprising SEQ ID NO: 1629 and a heavy chain variable region encoded by a polynucleotide sequence comprising SEQ ID NO: 1786; a light chain variable region encoded by a polynucleotide sequence comprising SEQ ID NO: 1630 and a heavy chain variable region encoded by a polynucleotide sequence comprising SEQ ID NO: 1787; a light chain variable region encoded by a polynucleotide sequence comprising SEQ ID NO: 1631 and a heavy chain variable region encoded by a polynucleotide sequence comprising SEQ ID NO: 1788; a light chain variable region encoded by a polynucleotide sequence comprising SEQ ID NO: 1632 and a heavy chain variable region encoded by a polynucleotide sequence comprising SEQ ID NO: 1789; a light chain variable region encoded by a polynucleotide sequence comprising SEQ ID NO: 1633 and a heavy chain variable region encoded by a polynucleotide sequence comprising SEQ ID NO: 1790; a light chain variable region encoded by a polynucleotide sequence comprising SEQ ID NO: 1634 and a heavy chain variable region encoded by a polynucleotide sequence comprising SEQ ID NO: 1791; a light chain variable region encoded by a polynucleotide sequence comprising SEQ ID NO: 1635 and a heavy chain variable region encoded by a polynucleotide sequence comprising SEQ ID NO: 1792; a light chain variable region encoded by a polynucleotide sequence comprising SEQ ID NO: 1636 and a heavy chain variable region encoded by a polynucleotide sequence comprising SEQ ID NO: 1793; a light chain variable region encoded by a polynucleotide sequence comprising SEQ ID NO: 1637 and a heavy chain variable region encoded by a polynucleotide sequence comprising SEQ ID NO: 1794; a light chain variable region encoded by a polynucleotide sequence comprising SEQ ID NO: 1638 and a heavy chain variable region encoded by a polynucleotide sequence comprising SEQ ID NO: 1795; a light chain variable region encoded by a polynucleotide sequence comprising SEQ ID NO: 1639 and a heavy chain variable region encoded by a polynucleotide sequence comprising SEQ ID NO: 1796; a light chain variable region encoded by a polynucleotide sequence comprising SEQ ID NO: 1640 and a heavy chain variable region encoded by a polynucleotide sequence comprising SEQ ID NO: 1797; a light chain variable region encoded by a polynucleotide sequence comprising SEQ ID NO: 1641 and a heavy chain variable region encoded by a polynucleotide sequence comprising SEQ ID NO: 1798; a light chain variable region encoded by a polynucleotide sequence comprising SEQ ID NO: 1642 and a heavy chain variable region encoded by a polynucleotide sequence comprising SEQ ID NO: 1799; a light chain variable region encoded by a polynucleotide sequence comprising SEQ ID NO: 1643 and a heavy chain variable region encoded by a polynucleotide sequence comprising SEQ ID NO: 1800; a light chain variable region encoded by a polynucleotide sequence comprising SEQ ID NO: 1644 and a heavy chain variable region encoded by a polynucleotide sequence comprising SEQ ID NO: 1801; a light chain variable region encoded by a polynucleotide sequence comprising SEQ ID NO: 1645 and a heavy chain variable region encoded by a polynucleotide sequence comprising SEQ ID NO: 1802; a light chain variable region encoded by a polynucleotide sequence comprising SEQ ID NO: 1646 and a heavy chain variable region encoded by a polynucleotide sequence comprising SEQ ID NO: 1803; a light chain variable region encoded by a polynucleotide sequence comprising SEQ ID NO: 1647 and a heavy chain variable region encoded by a polynucleotide sequence comprising SEQ ID NO: 1804; a light chain variable region encoded by a polynucleotide sequence comprising SEQ ID NO: 1648 and a heavy chain variable region encoded by a polynucleotide sequence comprising SEQ ID NO: 1805; a light chain variable region encoded by a polynucleotide sequence comprising SEQ ID NO: 1649 and a heavy chain variable region encoded by a polynucleotide sequence comprising SEQ ID NO: 1806; a light chain variable region encoded by a polynucleotide sequence comprising SEQ ID NO: 1650 and a heavy chain variable region encoded by a polynucleotide sequence comprising SEQ ID NO: 1807; a light chain variable region encoded by a polynucleotide sequence comprising SEQ ID NO: 1651 and a heavy chain variable region encoded by a polynucleotide sequence comprising SEQ ID NO: 1808; a light chain variable region encoded by a polynucleotide sequence comprising SEQ ID NO: 1652 and a heavy chain variable region encoded by a polynucleotide sequence comprising SEQ ID NO: 1809; a light chain variable region encoded by a polynucleotide sequence comprising SEQ ID NO: 1653 and a heavy chain variable region encoded by a polynucleotide sequence comprising SEQ ID NO: 1810; a light chain variable region encoded by a polynucleotide sequence comprising SEQ ID NO: 1654 and a heavy chain variable region encoded by a polynucleotide sequence comprising SEQ ID NO: 1811; a light chain variable region encoded by a polynucleotide sequence comprising SEQ ID NO: 1655 and a heavy chain variable region encoded by a polynucleotide sequence comprising SEQ ID NO: 1812; a light chain variable region encoded by a polynucleotide sequence comprising SEQ ID NO: 1656 and a heavy chain variable region encoded by a polynucleotide sequence comprising SEQ ID NO: 1813; a light chain variable region encoded by a polynucleotide sequence comprising SEQ ID NO: 1657 and a heavy chain variable region encoded by a polynucleotide sequence comprising SEQ ID NO: 1814; a light chain variable region encoded by a polynucleotide sequence comprising SEQ ID NO: 1658 and a heavy chain variable region encoded by a polynucleotide sequence comprising SEQ ID NO: 1815; a light chain variable region encoded by a polynucleotide sequence comprising SEQ ID NO: 1659 and a heavy chain variable region encoded by a polynucleotide sequence comprising SEQ ID NO: 1816; a light chain variable region encoded by a polynucleotide sequence comprising SEQ ID NO: 1660 and a heavy chain variable region encoded by a polynucleotide sequence comprising SEQ ID NO: 1817; a light chain variable region encoded by a polynucleotide sequence comprising SEQ ID NO: 1661 and a heavy chain variable region encoded by a polynucleotide sequence comprising SEQ ID NO: 1818; a light chain variable region encoded by a polynucleotide sequence comprising SEQ ID NO: 1662 and a heavy chain variable region encoded by a polynucleotide sequence comprising SEQ ID NO: 1819; a light chain variable region encoded by a polynucleotide sequence comprising SEQ ID NO: 1663 and a heavy chain variable region encoded by a polynucleotide sequence comprising SEQ ID NO: 1820; a light chain variable region encoded by a polynucleotide sequence comprising SEQ ID NO: 1664 and a heavy chain variable region encoded by a polynucleotide sequence comprising SEQ ID NO: 1821; a light chain variable region encoded by a polynucleotide sequence comprising SEQ ID NO: 1665 and a heavy chain variable region encoded by a polynucleotide sequence comprising SEQ ID NO: 1822; a light chain variable region encoded by a polynucleotide sequence comprising SEQ ID NO: 1666 and a heavy chain variable region encoded by a polynucleotide sequence comprising SEQ ID NO: 1823; a light chain variable region encoded by a polynucleotide sequence comprising SEQ ID NO: 1667 and a heavy chain variable region encoded by a polynucleotide sequence comprising SEQ ID NO: 1824; a light chain variable region encoded by a polynucleotide sequence comprising SEQ ID NO: 1668 and a heavy chain variable region encoded by a polynucleotide sequence comprising SEQ ID NO: 1825; a light chain variable region encoded by a polynucleotide sequence comprising SEQ ID NO: 1669 and a heavy chain variable region encoded by a polynucleotide sequence comprising SEQ ID NO: 1826; a light chain variable region encoded by a polynucleotide sequence comprising SEQ ID NO: 1670 and a heavy chain variable region encoded by a polynucleotide sequence comprising SEQ ID NO: 1827; a light chain variable region encoded by a polynucleotide sequence comprising SEQ ID NO: 1671 and a heavy chain variable region encoded by a polynucleotide sequence comprising SEQ ID NO: 1828; a light chain variable region encoded by a polynucleotide sequence comprising SEQ ID NO: 1672 and a heavy chain variable region encoded by a polynucleotide sequence comprising SEQ ID NO: 1829; a light chain variable region encoded by a polynucleotide sequence comprising SEQ ID NO: 1673 and a heavy chain variable region encoded by a polynucleotide sequence comprising SEQ ID NO: 1830; a light chain variable region encoded by a polynucleotide sequence comprising SEQ ID NO: 1674 and a heavy chain variable region encoded by a polynucleotide sequence comprising SEQ ID NO: 1831; a light chain variable region encoded by a polynucleotide sequence comprising SEQ ID NO: 1675 and a heavy chain variable region encoded by a polynucleotide sequence comprising SEQ ID NO: 1832; a light chain variable region encoded by a polynucleotide sequence comprising SEQ ID NO: 1676 and a heavy chain variable region encoded by a polynucleotide sequence comprising SEQ ID NO: 1833; a light chain variable region encoded by a polynucleotide sequence comprising SEQ ID NO: 1677 and a heavy chain variable region encoded by a polynucleotide sequence comprising SEQ ID NO: 1834; a light chain variable region encoded by a polynucleotide sequence comprising SEQ ID NO: 1678 and a heavy chain variable region encoded by a polynucleotide sequence comprising SEQ ID NO: 1835; a light chain variable region encoded by a polynucleotide sequence comprising SEQ ID NO: 1679 and a heavy chain variable region encoded by a polynucleotide sequence comprising SEQ ID NO: 1836; a light chain variable region encoded by a polynucleotide sequence comprising SEQ ID NO: 1680 and a heavy chain variable region encoded by a polynucleotide sequence comprising SEQ ID NO: 1837; a light chain variable region encoded by a polynucleotide sequence comprising SEQ ID NO: 1681 and a heavy chain variable region encoded by a polynucleotide sequence comprising SEQ ID NO: 1838; a light chain variable region encoded by a polynucleotide sequence comprising SEQ ID NO: 1682 and a heavy chain variable region encoded by a polynucleotide sequence comprising SEQ ID NO: 1839; a light chain variable region encoded by a polynucleotide sequence comprising SEQ ID NO: 1683 and a heavy chain variable region encoded by a polynucleotide sequence comprising SEQ ID NO: 1840; a light chain variable region encoded by a polynucleotide sequence comprising SEQ ID NO: 1684 and a heavy chain variable region encoded by a polynucleotide sequence comprising SEQ ID NO: 1841; a light chain variable region encoded by a polynucleotide sequence comprising SEQ ID NO: 1685 and a heavy chain variable region encoded by a polynucleotide sequence comprising SEQ ID NO: 1842; a light chain variable region encoded by a polynucleotide sequence comprising SEQ ID NO: 1686 and a heavy chain variable region encoded by a polynucleotide sequence comprising SEQ ID NO: 1843; a light chain variable region encoded by a polynucleotide sequence comprising SEQ ID NO: 1687 and a heavy chain variable region encoded by a polynucleotide sequence comprising SEQ ID NO: 1844; a light chain variable region encoded by a polynucleotide sequence comprising SEQ ID NO: 1688 and a heavy chain variable region encoded by a polynucleotide sequence comprising SEQ ID NO: 1845; a light chain variable region encoded by a polynucleotide sequence comprising SEQ ID NO: 1689 and a heavy chain variable region encoded by a polynucleotide sequence comprising SEQ ID NO: 1846; a light chain variable region encoded by a polynucleotide sequence comprising SEQ ID NO: 1690 and a heavy chain variable region encoded by a polynucleotide sequence comprising SEQ ID NO: 1847; a light chain variable region encoded by a polynucleotide sequence comprising SEQ ID NO: 1691 and a heavy chain variable region encoded by a polynucleotide sequence comprising SEQ ID NO: 1848; a light chain variable region encoded by a polynucleotide sequence comprising SEQ ID NO: 1692 and a heavy chain variable region encoded by a polynucleotide sequence comprising SEQ ID NO: 1849; a light chain variable region encoded by a polynucleotide sequence comprising SEQ ID NO: 1693 and a heavy chain variable region encoded by a polynucleotide sequence comprising SEQ ID NO: 1850; a light chain variable region encoded by a polynucleotide sequence comprising SEQ ID NO: 1694 and a heavy chain variable region encoded by a polynucleotide sequence comprising SEQ ID NO: 1851; a light chain variable region encoded by a polynucleotide sequence comprising SEQ ID NO: 1695 and a heavy chain variable region encoded by a polynucleotide sequence comprising SEQ ID NO: 1852; a light chain variable region encoded by a polynucleotide sequence comprising SEQ ID NO: 1696 and a heavy chain variable region encoded by a polynucleotide sequence comprising SEQ ID NO: 1853; a light chain variable region encoded by a polynucleotide sequence comprising SEQ ID NO: 1697 and a heavy chain variable region encoded by a polynucleotide sequence comprising SEQ ID NO: 1854; a light chain variable region encoded by a polynucleotide sequence comprising SEQ ID NO: 1698 and a heavy chain variable region encoded by a polynucleotide sequence comprising SEQ ID NO: 1855; a light chain variable region encoded by a polynucleotide sequence comprising SEQ ID NO: 1699 and a heavy chain variable region encoded by a polynucleotide sequence comprising SEQ ID NO: 1856; a light chain variable region encoded by a polynucleotide sequence comprising SEQ ID NO: 1700 and a heavy chain variable region encoded by a polynucleotide sequence comprising SEQ ID NO: 1857; a light chain variable region encoded by a polynucleotide sequence comprising SEQ ID NO: 1701 and a heavy chain variable region encoded by a polynucleotide sequence comprising SEQ ID NO: 1858; a light chain variable region encoded by a polynucleotide sequence comprising SEQ ID NO: 1702 and a heavy chain variable region encoded by a polynucleotide sequence comprising SEQ ID NO: 1859; a light chain variable region encoded by a polynucleotide sequence comprising SEQ ID NO: 1703 and a heavy chain variable region encoded by a polynucleotide sequence comprising SEQ ID NO: 1860; a light chain variable region encoded by a polynucleotide sequence comprising SEQ ID NO: 1704 and a heavy chain variable region encoded by a polynucleotide sequence comprising SEQ ID NO: 1861; a light chain variable region encoded by a polynucleotide sequence comprising SEQ ID NO: 1705 and a heavy chain variable region encoded by a polynucleotide sequence comprising SEQ ID NO: 1862; a light chain variable region encoded by a polynucleotide sequence comprising SEQ ID NO: 1706 and a heavy chain variable region encoded by a polynucleotide sequence comprising SEQ ID NO: 1863; a light chain variable region encoded by a polynucleotide sequence comprising SEQ ID NO: 1707 and a heavy chain variable region encoded by a polynucleotide sequence comprising SEQ ID NO: 1864; a light chain variable region encoded by a polynucleotide sequence comprising SEQ ID NO: 1708 and a heavy chain variable region encoded by a polynucleotide sequence comprising SEQ ID NO: 1865; a light chain variable region encoded by a polynucleotide sequence comprising SEQ ID NO: 1709 and a heavy chain variable region encoded by a polynucleotide sequence comprising SEQ ID NO: 1866; a light chain variable region encoded by a polynucleotide sequence comprising SEQ ID NO: 1710 and a heavy chain variable region encoded by a polynucleotide sequence comprising SEQ ID NO: 1867; a light chain variable region encoded by a polynucleotide sequence comprising SEQ ID NO: 1711 and a heavy chain variable region encoded by a polynucleotide sequence comprising SEQ ID NO: 1868; a light chain variable region encoded by a polynucleotide sequence comprising SEQ ID NO: 1712 and a heavy chain variable region encoded by a polynucleotide sequence comprising SEQ ID NO: 1869; a light chain variable region encoded by a polynucleotide sequence comprising SEQ ID NO: 1713 and a heavy chain variable region encoded by a polynucleotide sequence comprising SEQ ID NO: 1870; a light chain variable region encoded by a polynucleotide sequence comprising SEQ ID NO: 1714 and a heavy chain variable region encoded by a polynucleotide sequence comprising SEQ ID NO: 1871; a light chain variable region encoded by a polynucleotide sequence comprising SEQ ID NO: 1715 and a heavy chain variable region encoded by a polynucleotide sequence comprising SEQ ID NO: 1872; a light chain variable region encoded by a polynucleotide sequence comprising SEQ ID NO: 1716 and a heavy chain variable region encoded by a polynucleotide sequence comprising SEQ ID NO: 1873; a light chain variable region encoded by a polynucleotide sequence comprising SEQ ID NO: 1717 and a heavy chain variable region encoded by a polynucleotide sequence comprising SEQ ID NO: 1874; a light chain variable region encoded by a polynucleotide sequence comprising SEQ ID NO: 1718 and a heavy chain variable region encoded by a polynucleotide sequence comprising SEQ ID NO: 1875; a light chain variable region encoded by a polynucleotide sequence comprising SEQ ID NO: 1719 and a heavy chain variable region encoded by a polynucleotide sequence comprising SEQ ID NO: 1876; a light chain variable region encoded by a polynucleotide sequence comprising SEQ ID NO: 1720 and a heavy chain variable region encoded by a polynucleotide sequence comprising SEQ ID NO: 1877; a light chain variable region encoded by a polynucleotide sequence comprising SEQ ID NO: 1721 and a heavy chain variable region encoded by a polynucleotide sequence comprising SEQ ID NO: 1878; a light chain variable region encoded by a polynucleotide sequence comprising SEQ ID NO: 1722 and a heavy chain variable region encoded by a polynucleotide sequence comprising SEQ ID NO: 1879; a light chain variable region encoded by a polynucleotide sequence comprising SEQ ID NO: 1723 and a heavy chain variable region encoded by a polynucleotide sequence comprising SEQ ID NO: 1880; a light chain variable region encoded by a polynucleotide sequence comprising SEQ ID NO: 1724 and a heavy chain variable region encoded by a polynucleotide sequence comprising SEQ ID NO: 1881; a light chain variable region encoded by a polynucleotide sequence comprising SEQ ID NO: 1725 and a heavy chain variable region encoded by a polynucleotide sequence comprising SEQ ID NO: 1882; a light chain variable region encoded by a polynucleotide sequence comprising SEQ ID NO: 1726 and a heavy chain variable region encoded by a polynucleotide sequence comprising SEQ ID NO: 1883; and a light chain variable region encoded by a polynucleotide sequence comprising SEQ ID NO: 1727 and a heavy chain variable region encoded by a polynucleotide sequence comprising SEQ ID NO: 1884.

Some antigen binding proteins comprise a variable light domain and a variable heavy domain as listed in one of the rows for one of the antibodies listed in TABLE 3. In some instances, the antigen binding protein comprises two identical variable light domains and two identical variable heavy domains from one of the antibodies listed in TABLE 3. Some antigen binding proteins that are provided comprise a variable light domain and a variable heavy domain as listed in one of the rows for one of the antibodies listed in TABLE 3, except that one or both of the domains differs from the sequence specified in the table at only 1, 2, 3, 4, 5, 6, 7, 8, 9, 10, 11, 12, 13, 14 or 15 amino acid residues, wherein each such sequence difference is independently either a single amino acid deletion, insertion or substitution, with the deletions, insertions and/or substitutions resulting in no more than 1, 2, 3, 4, 5, 6, 7, 8, 9, 10, 11, 12, 13, 14 or 15 amino acid changes relative to the variable domain sequences specified in TABLE 3. In one embodiment, the antigen binding protein comprises a variable region sequence from Table 3, but with the N-terminal methionine deleted. Other antigen binding proteins also comprise a variable light domain and a variable heavy domain as listed in one of the rows for one of the antibodies listed in TABLE 3, except that one or both of the domains differs from the sequence specified in the table in that the heavy chain variable domain and/or light chain variable domain comprises or consists of a sequence of amino acids that has at least 70%, 75%, 80%, 85%, 90%, 95%, 96%, 97%, 98%, or 99% sequence identity to the amino acid sequences of the heavy chain variable domain or light chain variable domain sequences as specified in TABLE 3.

In another aspect, the antigen binding protein consists just of a variable light or variable heavy domain from an antibody listed in TABLE 3. In still another aspect, the antigen binding protein comprises two or more of the same variable heavy domains or two or more of the same variable light domains from those listed in TABLE 3. Such domain antibodies can be fused together or joined via a linker as described in greater detail below. The domain antibodies can also be fused or linked to one or more molecules to extend the half-life (e.g., PEG or albumin).

Other antigen binding proteins that are provided are variants of antibodies formed by combination of the heavy and light chains shown in TABLE 3 and comprise light and/or heavy chains that each have at least 70%, 75%, 80%, 85%, 90%, 95%, 96%, 97%, 98% or 99% identity to the amino acid sequences of these chains. In some instances, such antibodies include at least one heavy chain and one light chain, whereas in other instances the variant forms contain two identical light chains and two identical heavy chains.

The various combinations of heavy chain variable regions may be combined with any of the various combinations of light chain variable regions.

In a further embodiment, the isolated antigen binding protein provided herein is a human antibody comprising a sequence as set forth in TABLE 3 and is of the $IgG_1$-, $IgG_2$-$IgG_3$- or $IgG_4$-type.

The antigen binding proteins disclosed herein are polypeptides into which one or more CDRs are grafted, inserted and/or joined. An antigen binding protein can have 1, 2, 3, 4, 5 or 6 CDRs. An antigen binding protein thus can have, for example, one heavy chain CDR1 ("CDRH1"), and/or one heavy chain CDR2 ("CDRH2"), and/or one heavy chain CDR3 ("CDRH3"), and/or one light chain CDR1 ("CDRL1"), and/or one light chain CDR2 ("CDRL2"), and/or one light chain CDR3 ("CDRL3"). Some antigen binding proteins include both a CDRH3 and a CDRL3. Specific light and heavy chain CDRs are identified in TABLEs 4A and 4B, respectively.

Complementarity determining regions (CDRs) and framework regions (FR) of a given antibody may be identified using the system described by Kabat et al. in Sequences of Proteins of Immunological Interest, 5th Ed., US Dept. of Health and Human Services, PHS, NIH, NIH Publication no. 91-3242, 1991. Certain antibodies that are disclosed herein comprise one or more amino acid sequences that are identical or have substantial sequence identity to the amino acid sequences of one or more of the CDRs presented in TABLES 4A and 4B. These CDRs use the system described by Kabat et al. as noted above.

The structure and properties of CDRs within a naturally occurring antibody has been described, supra. Briefly, in a traditional antibody, the CDRs are embedded within a framework in the heavy and light chain variable region where they constitute the regions responsible for antigen binding and recognition. A variable region comprises at least three heavy or light chain CDRs, see, supra (Kabat et al., 1991, *Sequences of Proteins of Immunological Interest*, Public Health Service N.I.H., Bethesda, Md.; see also Chothia and Lesk, 1987, *J. Mol. Biol.* 196:901-917; Chothia et al., 1989, *Nature* 342: 877-883), within a framework region (designated framework regions 1-4, FR1, FR2, FR3, and FR4, by Kabat et al., 1991, supra; see also Chothia and Lesk, 1987, supra). The CDRs provided herein, however, may not only be used to define the antigen binding domain of a traditional antibody structure, but may be embedded in a variety of other polypeptide structures, as described herein.

In one embodiment the antibody or fragment thereof comprises a CDRL1, a CDRL2, a CDRL3, a CDRH1, a CDRH2, and a CDRH3. In one embodiment the antibody or fragment thereof comprises a CDRL1 comprising a sequence selected from the group consisting of SEQ ID NOs: 629-785. In one embodiment the antibody or fragment thereof comprises a CDRL2 comprising a sequence selected from the group consisting of SEQ ID NOs: 786-942. In one embodiment the antibody or fragment thereof comprises a CDRL3 comprising a sequence selected from the group consisting of SEQ ID NOs: 943-1099. In one embodiment the antibody or fragment thereof comprises a CDRH1 comprising a sequence selected from the group consisting of SEQ ID NOs: 1100-1256. In one embodiment the antibody or fragment thereof comprises a CDRH2 comprising a sequence selected from the group consisting of SEQ ID NOs: 1257-1413. In one embodiment the antibody or fragment thereof comprises a CDRH3 comprising a sequence selected from the group consisting of SEQ ID NOs: 1414-1570. In one embodiment the antibody or fragment thereof comprises a CDRL1, a CDRL2, a CDRL3, a CDRH1, a CDRH2, and a CDRH3, wherein each CDRL1, CDRL2, CDRL3, CDRH1, CDRH2, and CDRH3, respectively, comprises a sequence selected from the group consisting of SEQ ID NO: 629, SEQ ID NO: 786, SEQ ID NO: 943, SEQ ID NO: 1100, SEQ ID NO: 1257, and SEQ ID NO: 1414; SEQ ID NO: 630, SEQ ID NO: 787, SEQ ID NO: 944, SEQ ID NO: 1101, SEQ ID NO: 1258, and SEQ ID NO: 1415; SEQ ID NO: 631, SEQ ID NO: 788, SEQ ID NO: 945, SEQ ID NO: 1102, SEQ ID NO: 1259, and SEQ ID NO: 1416; SEQ ID NO: 632, SEQ ID NO: 789, SEQ ID NO: 946, SEQ ID NO: 1103, SEQ ID NO: 1260, and SEQ ID NO: 1417; SEQ ID NO: 633, SEQ ID NO: 790, SEQ ID NO: 947, SEQ ID NO: 1104, SEQ ID NO: 1261, and SEQ ID NO: 1418; SEQ ID NO: 634, SEQ ID NO: 791, SEQ ID NO: 948, SEQ ID NO: 1105, SEQ ID NO: 1262, and SEQ ID NO: 1419; SEQ ID NO: 635, SEQ ID NO: 792, SEQ ID NO: 949, SEQ ID NO: 1106, SEQ ID NO: 1263, and SEQ ID NO: 1420; SEQ ID NO: 636, SEQ ID NO: 793, SEQ ID NO: 950, SEQ ID NO: 1107, SEQ ID NO: 1264, and SEQ ID NO: 1421; SEQ ID NO: 637, SEQ ID NO: 794, SEQ ID NO: 951, SEQ ID NO: 1108, SEQ ID NO: 1265, and SEQ ID NO: 1422; SEQ ID NO: 638, SEQ ID NO: 795, SEQ ID NO: 952, SEQ ID NO: 1109, SEQ ID NO: 1266, and SEQ ID NO: 1423; SEQ ID NO: 639, SEQ ID NO: 796, SEQ ID NO: 953, SEQ ID NO: 1110, SEQ ID NO: 1267, and SEQ ID NO: 1424; SEQ ID NO: 640, SEQ ID NO: 797, SEQ ID NO: 954, SEQ ID NO: 1111, SEQ ID NO: 1268, and SEQ ID NO: 1425; SEQ ID NO: 641, SEQ ID NO: 798, SEQ ID NO: 955, SEQ ID NO: 1112, SEQ ID NO: 1269, and SEQ ID NO: 1426; SEQ ID NO: 642, SEQ ID NO: 799, SEQ ID NO: 956, SEQ ID NO: 1113, SEQ ID NO: 1270, and SEQ ID NO: 1427; SEQ ID NO: 643, SEQ ID NO: 800, SEQ ID NO: 957, SEQ ID NO: 1114, SEQ ID NO: 1271, and SEQ ID NO: 1428; SEQ ID NO: 644, SEQ ID NO: 801, SEQ ID NO: 958, SEQ ID NO: 1115, SEQ ID NO: 1272, and SEQ ID NO: 1429; SEQ ID NO: 645, SEQ ID NO: 802, SEQ ID NO: 959, SEQ ID NO: 1116, SEQ ID NO: 1273, and SEQ ID NO: 1430; SEQ ID NO: 646, SEQ ID NO: 803, SEQ ID NO: 960, SEQ ID NO: 1117, SEQ ID NO: 1274, and SEQ ID NO: 1431; SEQ ID NO: 647, SEQ ID NO: 804, SEQ ID NO: 961, SEQ ID NO: 1118, SEQ ID NO: 1275, and SEQ ID NO: 1432; SEQ ID NO: 648, SEQ ID NO: 805, SEQ ID NO: 962, SEQ ID NO: 1119, SEQ ID NO: 1276, and SEQ ID NO: 1433; SEQ ID NO: 649, SEQ ID NO: 806, SEQ ID NO: 963, SEQ ID NO: 1120, SEQ ID NO: 1277, and SEQ ID NO: 1434; SEQ ID NO: 650, SEQ ID NO: 807, SEQ ID NO: 964, SEQ ID NO: 1121, SEQ ID NO: 1278, and SEQ ID NO: 1435; SEQ ID NO: 651, SEQ ID NO: 808, SEQ ID NO: 965, SEQ ID NO: 1122, SEQ ID NO: 1279, and SEQ ID NO: 1436; SEQ ID NO: 652, SEQ ID NO: 809, SEQ ID NO: 966, SEQ ID NO: 1123, SEQ ID NO: 1280, and SEQ ID NO: 1437; SEQ ID NO: 653, SEQ ID NO: 810, SEQ ID NO: 967, SEQ ID NO: 1124, SEQ ID NO: 1281, and SEQ ID NO: 1438; SEQ ID NO: 654, SEQ ID NO: 811, SEQ ID NO: 968, SEQ ID NO: 1125, SEQ ID NO: 1282, and SEQ ID NO: 1439; SEQ ID NO: 655, SEQ ID NO: 812, SEQ ID NO: 969, SEQ ID NO: 1126, SEQ ID NO: 1283, and SEQ ID NO: 1440; SEQ ID NO: 656, SEQ ID NO: 813, SEQ ID NO: 970, SEQ ID NO: 1127, SEQ ID NO: 1284, and SEQ ID NO: 1441; SEQ ID NO: 657, SEQ ID NO: 814, SEQ ID NO: 971, SEQ ID NO: 1128, SEQ ID NO: 1285, and SEQ ID NO: 1442; SEQ ID NO: 658, SEQ ID NO: 815, SEQ ID NO: 972, SEQ ID NO: 1129, SEQ ID NO: 1286, and SEQ ID NO: 1443; SEQ ID NO: 659, SEQ ID NO: 816, SEQ ID NO: 973, SEQ ID NO: 1130, SEQ ID NO: 1287, and SEQ ID NO: 1444; SEQ ID NO: 660, SEQ ID NO: 817, SEQ ID NO: 974, SEQ ID NO: 1131, SEQ ID NO: 1288, and SEQ ID NO: 1445; SEQ ID NO: 661, SEQ ID NO: 818, SEQ ID NO: 975, SEQ ID NO: 1132, SEQ ID NO: 1289, and SEQ ID NO: 1446; SEQ ID NO: 662, SEQ ID NO: 819, SEQ ID NO: 976, SEQ ID NO: 1133, SEQ ID NO: 1290, and SEQ ID NO: 1447; SEQ ID NO: 663, SEQ ID NO: 820, SEQ ID NO: 977, SEQ ID NO: 1134, SEQ ID NO: 1291, and SEQ ID NO: 1448; SEQ ID NO: 664, SEQ ID NO: 821, SEQ ID NO: 978, SEQ ID NO: 1135, SEQ ID NO: 1292, and SEQ ID NO: 1449; SEQ ID NO: 665, SEQ ID NO: 822, SEQ ID NO: 979, SEQ ID NO: 1136, SEQ ID NO: 1293, and SEQ ID NO: 1450; SEQ ID NO: 666, SEQ ID NO: 823, SEQ ID NO: 980, SEQ ID NO: 1137, SEQ ID NO: 1294, and SEQ ID NO: 1451; SEQ ID NO: 667, SEQ ID NO: 824, SEQ ID NO: 981, SEQ ID NO: 1138, SEQ ID NO: 1295, and SEQ ID NO: 1452; SEQ ID NO: 668, SEQ ID NO: 825, SEQ ID NO: 982, SEQ ID NO: 1139, SEQ ID NO: 1296, and SEQ ID NO: 1453; SEQ ID NO: 669, SEQ ID NO: 826, SEQ ID NO: 983, SEQ ID NO: 1140, SEQ ID NO: 1297, and SEQ ID NO: 1454; SEQ ID NO: 670, SEQ ID NO: 827, SEQ ID NO: 984, SEQ ID NO: 1141, SEQ ID NO: 1298, and SEQ ID NO: 1455; SEQ ID NO: 671, SEQ ID NO: 828, SEQ ID NO: 985, SEQ ID NO: 1142, SEQ ID NO: 1299, and SEQ ID NO: 1456; SEQ ID NO: 672, SEQ ID NO: 829, SEQ ID NO: 986, SEQ ID NO: 1143, SEQ ID NO: 1300, and SEQ ID NO: 1457; SEQ ID NO: 673, SEQ ID NO: 830, SEQ ID NO: 987, SEQ ID NO: 1144, SEQ ID NO: 1301, and SEQ ID NO: 1458; SEQ ID NO: 674, SEQ ID NO: 831, SEQ ID NO: 988, SEQ ID NO: 1145, SEQ ID NO: 1302, and SEQ ID NO: 1459; SEQ ID NO: 675, SEQ ID NO: 832, SEQ ID NO: 989, SEQ ID NO: 1146, SEQ ID NO: 1303, and SEQ ID NO: 1460; SEQ ID NO: 676, SEQ ID NO: 833, SEQ ID NO: 990, SEQ ID NO: 1147, SEQ ID NO: 1304, and SEQ ID NO: 1461; SEQ ID NO: 677, SEQ ID NO: 834, SEQ ID NO: 991, SEQ ID NO: 1148, SEQ ID NO: 1305, and SEQ ID NO: 1462; SEQ ID NO: 678, SEQ ID NO: 835, SEQ ID NO: 992, SEQ ID NO: 1149, SEQ ID NO: 1306, and SEQ ID NO: 1463; SEQ ID NO: 679, SEQ ID NO: 836, SEQ ID NO: 993, SEQ ID NO: 1150, SEQ ID NO: 1307, and SEQ ID NO: 1464; SEQ ID NO: 680, SEQ ID NO: 837, SEQ ID NO: 994, SEQ ID NO: 1151, SEQ ID NO: 1308, and SEQ ID NO: 1465; SEQ ID NO: 681, SEQ ID NO: 838, SEQ ID NO: 995, SEQ ID NO: 1152, SEQ ID NO: 1309, and SEQ ID NO: 1466; SEQ ID NO: 682, SEQ ID NO: 839, SEQ ID NO: 996, SEQ ID NO: 1153, SEQ ID NO: 1310, and SEQ ID NO: 1467; SEQ ID NO: 683, SEQ ID NO: 840, SEQ ID NO: 997, SEQ ID NO: 1154, SEQ ID NO: 1311, and SEQ ID NO: 1468; SEQ ID NO: 684, SEQ ID NO: 841, SEQ ID NO: 998, SEQ ID NO: 1155, SEQ ID NO: 1312, and SEQ ID NO: 1469; SEQ ID NO: 685, SEQ ID NO: 842, SEQ ID NO: 999, SEQ ID NO: 1156, SEQ ID NO: 1313, and SEQ ID NO: 1470; SEQ ID NO: 686, SEQ ID NO: 843, SEQ ID NO: 1000, SEQ ID NO: 1157, SEQ ID NO: 1314, and SEQ ID NO: 1471; SEQ ID NO: 687, SEQ ID NO: 844, SEQ ID NO: 1001, SEQ ID NO: 1158, SEQ ID NO: 1315, and SEQ ID NO: 1472; SEQ ID NO: 688, SEQ ID NO: 845, SEQ ID NO: 1002, SEQ ID NO: 1159, SEQ ID NO: 1316, and SEQ ID NO: 1473; SEQ ID NO: 689, SEQ ID NO: 846, SEQ ID NO: 1003, SEQ ID NO: 1160, SEQ ID NO: 1317, and SEQ ID NO: 1474; SEQ ID NO: 690, SEQ ID NO: 847, SEQ ID NO: 1004, SEQ ID NO: 1161, SEQ ID NO: 1318, and SEQ ID NO: 1475; SEQ ID NO: 691, SEQ ID NO: 848, SEQ ID NO: 1005, SEQ ID NO: 1162, SEQ ID NO: 1319, and SEQ ID NO: 1476; SEQ ID NO: 692, SEQ ID NO: 849, SEQ ID NO: 1006, SEQ ID NO: 1163, SEQ ID NO: 1320, and SEQ ID NO: 1477; SEQ ID NO: 693, SEQ ID NO: 850, SEQ ID NO: 1007, SEQ ID NO: 1164, SEQ ID NO: 1321, and SEQ ID NO: 1478; SEQ ID NO: 694, SEQ ID NO: 851, SEQ ID NO: 1008, SEQ ID NO: 1165, SEQ ID NO: 1322, and SEQ ID NO: 1479; SEQ ID NO: 695, SEQ ID NO: 852, SEQ ID NO: 1009, SEQ ID NO: 1166, SEQ ID NO: 1323, and SEQ ID NO: 1480; SEQ ID NO: 696, SEQ ID NO: 853, SEQ ID NO: 1010, SEQ ID NO: 1167, SEQ ID NO: 1324, and SEQ ID NO: 1481; SEQ ID NO: 697, SEQ ID NO: 854, SEQ ID NO: 1011, SEQ ID NO: 1168, SEQ ID NO: 1325, and SEQ ID NO: 1482; SEQ ID NO: 698, SEQ ID NO: 855, SEQ ID NO: 1012, SEQ ID NO: 1169, SEQ ID NO: 1326, and SEQ ID NO: 1483; SEQ ID NO: 699, SEQ ID NO: 856, SEQ ID NO: 1013, SEQ ID NO: 1170, SEQ ID NO: 1327, and SEQ ID NO: 1484; SEQ ID NO: 700, SEQ ID NO: 857, SEQ ID NO: 1014, SEQ ID NO: 1171, SEQ ID NO: 1328, and SEQ ID NO: 1485; SEQ ID NO: 701, SEQ ID NO: 858, SEQ ID NO: 1015, SEQ ID NO: 1172, SEQ ID NO: 1329, and SEQ ID NO: 1486; SEQ ID NO: 702, SEQ ID NO: 859, SEQ ID NO: 1016, SEQ ID NO: 1173, SEQ ID NO: 1330, and SEQ ID NO: 1487; SEQ ID NO: 703, SEQ ID NO: 860, SEQ ID NO: 1017, SEQ ID NO: 1174, SEQ ID NO: 1331, and SEQ ID NO: 1488; SEQ ID NO: 704, SEQ ID NO: 861, SEQ ID NO: 1018, SEQ ID NO: 1175, SEQ ID NO: 1332, and SEQ ID NO: 1489; SEQ ID NO: 705, SEQ ID NO: 862, SEQ ID NO: 1019, SEQ ID NO: 1176, SEQ ID NO: 1333, and SEQ ID NO: 1490; SEQ ID NO: 706, SEQ ID NO: 863, SEQ ID NO: 1020, SEQ ID NO: 1177, SEQ ID NO: 1334, and SEQ ID NO: 1491; SEQ ID NO: 707, SEQ ID NO: 864, SEQ ID NO: 1021, SEQ ID NO: 1178, SEQ ID NO: 1335, and SEQ ID NO: 1492; SEQ ID NO: 708, SEQ ID NO: 865, SEQ ID NO: 1022, SEQ ID NO: 1179, SEQ ID NO: 1336, and SEQ ID NO: 1493; SEQ ID NO: 709, SEQ ID NO: 866, SEQ ID NO: 1023, SEQ ID NO: 1180, SEQ ID NO: 1337, and SEQ ID NO: 1494; SEQ ID NO: 710, SEQ ID NO: 867, SEQ ID NO: 1024, SEQ ID NO: 1181, SEQ ID NO: 1338, and SEQ ID NO: 1495; SEQ ID NO: 711, SEQ ID NO: 868, SEQ ID NO: 1025, SEQ ID NO: 1182, SEQ ID NO: 1339, and SEQ ID NO: 1496; SEQ ID NO: 712, SEQ ID NO: 869, SEQ ID NO: 1026, SEQ ID NO: 1183, SEQ ID NO: 1340, and SEQ ID NO: 1497; SEQ ID NO: 713, SEQ ID NO: 870, SEQ ID NO: 1027, SEQ ID NO: 1184, SEQ ID NO: 1341, and SEQ ID NO: 1498; SEQ ID NO: 714, SEQ ID NO: 871, SEQ ID NO: 1028, SEQ ID NO: 1185, SEQ ID NO: 1342, and SEQ ID NO: 1499; SEQ ID NO: 715, SEQ ID NO: 872, SEQ ID NO: 1029, SEQ ID NO: 1186, SEQ ID NO: 1343, and SEQ ID NO: 1500; SEQ ID NO: 716, SEQ ID NO: 873, SEQ ID NO: 1030, SEQ ID NO: 1187, SEQ ID NO: 1344, and SEQ ID NO: 1501; SEQ ID NO: 717, SEQ ID NO: 874, SEQ ID NO: 1031, SEQ ID NO: 1188, SEQ ID NO: 1345, and SEQ ID NO: 1502; SEQ ID NO: 718, SEQ ID NO: 875, SEQ ID NO: 1032, SEQ ID NO: 1189, SEQ ID NO: 1346, and SEQ ID NO: 1503; SEQ ID NO: 719, SEQ ID NO: 876, SEQ ID NO: 1033, SEQ ID NO: 1190, SEQ ID NO: 1347, and SEQ ID NO: 1504; SEQ ID NO: 720, SEQ ID NO: 877, SEQ ID NO: 1034, SEQ ID NO: 1191, SEQ ID NO: 1348, and SEQ ID NO: 1505; SEQ ID NO: 721, SEQ ID NO: 878, SEQ ID NO: 1035, SEQ ID NO: 1192, SEQ ID NO: 1349, and SEQ ID NO: 1506; SEQ ID NO: 722, SEQ ID NO: 879, SEQ ID NO: 1036, SEQ ID NO: 1193, SEQ ID NO: 1350, and SEQ ID NO: 1507; SEQ ID NO: 723, SEQ ID NO: 880, SEQ ID NO: 1037, SEQ ID NO: 1194, SEQ ID NO: 1351, and SEQ ID NO: 1508; SEQ ID NO: 724, SEQ ID NO: 881, SEQ ID NO: 1038, SEQ ID NO: 1195, SEQ ID NO: 1352, and SEQ ID NO: 1509; SEQ ID NO: 725, SEQ ID NO: 882, SEQ ID NO: 1039, SEQ ID NO: 1196, SEQ ID NO: 1353, and SEQ ID NO: 1510; SEQ ID NO: 726, SEQ ID NO: 883, SEQ ID NO: 1040, SEQ ID NO: 1197, SEQ ID NO: 1354, and SEQ ID NO: 1511; SEQ ID NO: 727, SEQ ID NO: 884, SEQ ID NO: 1041, SEQ ID NO: 1198, SEQ ID NO: 1355, and SEQ ID NO: 1512; SEQ ID NO: 728, SEQ ID NO: 885, SEQ ID NO: 1042, SEQ ID NO: 1199, SEQ ID NO: 1356, and SEQ ID NO: 1513; SEQ ID NO: 729, SEQ ID NO: 886, SEQ ID NO: 1043, SEQ ID NO: 1200, SEQ ID NO: 1357, and SEQ ID NO: 1514; SEQ ID NO: 730, SEQ ID NO: 887, SEQ ID NO: 1044, SEQ ID NO: 1201, SEQ ID NO: 1358, and SEQ ID NO: 1515; SEQ ID NO: 731, SEQ ID NO: 888, SEQ ID NO: 1045, SEQ ID NO: 1202, SEQ ID NO: 1359, and SEQ ID NO: 1516; SEQ ID NO: 732, SEQ ID NO: 889, SEQ ID NO: 1046, SEQ ID NO: 1203, SEQ ID NO: 1360, and SEQ ID NO: 1517; SEQ ID NO: 733, SEQ ID NO: 890, SEQ ID NO: 1047, SEQ ID NO: 1204, SEQ ID NO: 1361, and SEQ ID NO: 1518; SEQ ID NO: 734, SEQ ID NO: 891, SEQ ID NO: 1048, SEQ ID NO: 1205, SEQ ID NO: 1362, and SEQ ID NO: 1519; SEQ ID NO: 735, SEQ ID NO: 892, SEQ ID NO: 1049, SEQ ID NO: 1206, SEQ ID NO: 1363, and SEQ ID NO: 1520; SEQ ID NO: 736, SEQ ID NO: 893, SEQ ID NO: 1050, SEQ ID NO: 1207, SEQ ID NO: 1364, and SEQ ID NO: 1521; SEQ ID NO: 737, SEQ ID NO: 894, SEQ ID NO: 1051, SEQ ID NO: 1208, SEQ ID NO: 1365, and SEQ ID NO: 1522; SEQ ID NO: 738, SEQ ID NO: 895, SEQ ID NO: 1052, SEQ ID NO: 1209, SEQ ID NO: 1366, and SEQ ID NO: 1523; SEQ ID NO: 739, SEQ ID NO: 896, SEQ ID NO: 1053, SEQ ID NO: 1210, SEQ ID NO: 1367, and SEQ ID NO: 1524; SEQ ID NO: 740, SEQ ID NO: 897, SEQ ID NO: 1054, SEQ ID NO: 1211, SEQ ID NO: 1368, and SEQ ID NO: 1525; SEQ ID NO: 741, SEQ ID NO: 898, SEQ ID NO: 1055, SEQ ID NO: 1212, SEQ ID NO: 1369, and SEQ ID NO: 1526; SEQ ID NO: 742, SEQ ID NO: 899, SEQ ID NO: 1056, SEQ ID NO: 1213, SEQ ID NO: 1370, and SEQ ID NO: 1527; SEQ ID NO: 743, SEQ ID NO: 900, SEQ ID NO: 1057, SEQ ID NO: 1214, SEQ ID NO: 1371, and SEQ ID NO: 1528; SEQ ID NO: 744, SEQ ID NO: 901, SEQ ID NO: 1058, SEQ ID NO: 1215, SEQ ID NO: 1372, and SEQ ID NO: 1529; SEQ ID NO: 745, SEQ ID NO: 902, SEQ ID NO: 1059, SEQ ID NO: 1216, SEQ ID NO: 1373, and SEQ ID NO: 1530; SEQ ID NO: 746, SEQ ID NO: 903, SEQ ID NO: 1060, SEQ ID NO: 1217, SEQ ID NO: 1374, and SEQ ID NO: 1531; SEQ ID NO: 747, SEQ ID NO: 904, SEQ ID NO: 1061, SEQ ID NO: 1218, SEQ ID NO: 1375, and SEQ ID NO: 1532; SEQ ID NO: 748, SEQ ID NO: 905, SEQ ID NO: 1062, SEQ ID NO: 1219, SEQ ID NO: 1376, and SEQ ID NO: 1533; SEQ ID NO: 749, SEQ ID NO: 906, SEQ ID NO: 1063, SEQ ID NO: 1220, SEQ ID NO: 1377, and SEQ ID NO: 1534; SEQ ID NO: 750, SEQ ID NO: 907, SEQ ID NO: 1064, SEQ ID NO: 1221, SEQ ID NO: 1378, and SEQ ID NO: 1535; SEQ ID NO: 751, SEQ ID NO: 908, SEQ ID NO: 1065, SEQ ID NO: 1222, SEQ ID NO: 1379, and SEQ ID NO: 1536; SEQ ID NO: 752, SEQ ID NO: 909, SEQ ID NO: 1066, SEQ ID NO: 1223, SEQ ID NO: 1380, and SEQ ID NO: 1537; SEQ ID NO: 753, SEQ ID NO: 910, SEQ ID NO: 1067, SEQ ID NO: 1224, SEQ ID NO: 1381, and SEQ ID NO: 1538; SEQ ID NO: 754, SEQ ID NO: 911, SEQ ID NO: 1068, SEQ ID NO: 1225, SEQ ID NO: 1382, and SEQ ID NO: 1539; SEQ ID NO: 755, SEQ ID NO: 912, SEQ ID NO: 1069, SEQ ID NO: 1226, SEQ ID NO: 1383, and SEQ ID NO: 1540; SEQ ID NO: 756, SEQ ID NO: 913, SEQ ID NO: 1070, SEQ ID NO: 1227, SEQ ID NO: 1384, and SEQ ID NO: 1541; SEQ ID NO: 757, SEQ ID NO: 914, SEQ ID NO: 1071, SEQ ID NO: 1228, SEQ ID NO: 1385, and SEQ ID NO: 1542; SEQ ID NO: 758, SEQ ID NO: 915, SEQ ID NO: 1072, SEQ ID NO: 1229, SEQ ID NO: 1386, and SEQ ID NO: 1543; SEQ ID NO: 759, SEQ ID NO: 916, SEQ ID NO: 1073, SEQ ID NO: 1230, SEQ ID NO: 1387, and SEQ ID NO: 1544; SEQ ID NO: 760, SEQ ID NO: 917, SEQ ID NO: 1074, SEQ ID NO: 1231, SEQ ID NO: 1388, and SEQ ID NO: 1545; SEQ ID NO: 761, SEQ ID NO: 918, SEQ ID NO: 1075, SEQ ID NO: 1232, SEQ ID NO: 1389, and SEQ ID NO: 1546; SEQ ID NO: 762, SEQ ID NO: 919, SEQ ID NO: 1076, SEQ ID NO: 1233, SEQ ID NO: 1390, and SEQ ID NO: 1547; SEQ ID NO: 763, SEQ ID NO: 920, SEQ ID NO: 1077, SEQ ID NO: 1234, SEQ ID NO: 1391, and SEQ ID NO: 1548; SEQ ID NO: 764, SEQ ID NO: 921, SEQ ID NO: 1078, SEQ ID NO: 1235, SEQ ID NO: 1392, and SEQ ID NO: 1549; SEQ ID NO: 765, SEQ ID NO: 922, SEQ ID NO: 1079, SEQ ID NO: 1236, SEQ ID NO: 1393, and SEQ ID NO: 1550; SEQ ID NO: 766, SEQ ID NO: 923, SEQ ID NO: 1080, SEQ ID NO: 1237, SEQ ID NO: 1394, and SEQ ID NO: 1551; SEQ ID NO: 767, SEQ ID NO: 924, SEQ ID NO: 1081, SEQ ID NO: 1238, SEQ ID NO: 1395, and SEQ ID NO: 1552; SEQ ID NO: 768, SEQ ID NO: 925, SEQ ID NO: 1082, SEQ ID NO: 1239, SEQ ID NO: 1396, and SEQ ID NO: 1553; SEQ ID NO: 769, SEQ ID NO: 926, SEQ ID NO: 1083, SEQ ID NO: 1240, SEQ ID NO: 1397, and SEQ ID NO: 1554; SEQ ID NO: 770, SEQ ID NO: 927, SEQ ID NO: 1084, SEQ ID NO: 1241, SEQ ID NO: 1398, and SEQ ID NO: 1555; SEQ ID NO: 771, SEQ ID NO: 928, SEQ ID NO: 1085, SEQ ID NO: 1242, SEQ ID NO: 1399, and SEQ ID NO: 1556; SEQ ID NO: 772, SEQ ID NO: 929, SEQ ID NO: 1086, SEQ ID NO: 1243, SEQ ID NO: 1400, and SEQ ID NO: 1557; SEQ ID NO: 773, SEQ ID NO: 930, SEQ ID NO: 1087, SEQ ID NO: 1244, SEQ ID NO: 1401, and SEQ ID NO: 1558; SEQ ID NO: 774, SEQ ID NO: 931, SEQ ID NO: 1088, SEQ ID NO: 1245, SEQ ID NO: 1402, and SEQ ID NO: 1559; SEQ ID NO: 775, SEQ ID NO: 932, SEQ ID NO: 1089, SEQ ID NO: 1246, SEQ ID NO: 1403, and SEQ ID NO: 1560; SEQ ID NO: 776, SEQ ID NO: 933, SEQ ID NO: 1090, SEQ ID NO: 1247, SEQ ID NO: 1404, and SEQ ID NO: 1561; SEQ ID NO: 777, SEQ ID NO: 934, SEQ ID NO: 1091, SEQ ID NO: 1248, SEQ ID NO: 1405, and SEQ ID NO: 1562; SEQ ID NO: 778, SEQ ID NO: 935, SEQ ID NO: 1092, SEQ ID NO: 1249, SEQ ID NO: 1406, and SEQ ID NO: 1563; SEQ ID NO: 779, SEQ ID NO: 936, SEQ ID NO: 1093, SEQ ID NO: 1250, SEQ ID NO: 1407, and SEQ ID NO: 1564; SEQ ID NO: 780, SEQ ID NO: 937, SEQ ID NO: 1094, SEQ ID NO: 1251, SEQ ID NO: 1408, and SEQ ID NO: 1565; SEQ ID NO: 781, SEQ ID NO: 938, SEQ ID NO: 1095, SEQ ID NO: 1252, SEQ ID NO: 1409, and SEQ ID NO: 1566; SEQ ID NO: 782, SEQ ID NO: 939, SEQ ID NO: 1096, SEQ ID NO: 1253, SEQ ID NO: 1410, and SEQ ID NO: 1567; SEQ ID NO: 783, SEQ ID NO: 940, SEQ ID NO: 1097, SEQ ID NO: 1254, SEQ ID NO: 1411, and SEQ ID NO: 1568; SEQ ID NO: 784, SEQ ID NO: 941, SEQ ID NO: 1098, SEQ ID NO: 1255, SEQ ID NO: 1412, and SEQ ID NO: 1569; and SEQ ID NO: 785, SEQ ID NO: 942, SEQ ID NO: 1099, SEQ ID NO: 1256, SEQ ID NO: 1413, and SEQ ID NO: 1570.

In one embodiment the antibody or fragment thereof comprises a CDRL1, a CDRL2, a CDRL3, a CDRH1, a CDRH2, and a CDRH3 encoded by a polynucleotide. In one embodiment the antibody or fragment thereof comprises a CDRL1 encoded by a polynucleotide sequence selected from the group consisting of SEQ ID NOs: 2199-2355. In one embodiment the antibody or fragment thereof comprises a CDRL2 encoded by a polynucleotide sequence selected from the group consisting of SEQ ID NOs: 2356-2512. In one embodiment the antibody or fragment thereof comprises a CDRL3 encoded by a polynucleotide sequence selected from the group consisting of SEQ ID NOs: 2513-2669. In one embodiment the antibody or fragment thereof comprises a CDRH1 encoded by a polynucleotide sequence selected from the group consisting of SEQ ID NOs: 2700-2826. In one embodiment the antibody or fragment thereof comprises a CDRH2 encoded by a polynucleotide sequence selected from the group consisting of SEQ ID NOs: 2827-2983. In one embodiment the antibody or fragment thereof comprises a CDRH3 encoded by a polynucleotide sequence selected from the group consisting of SEQ ID NOs: 2984-3140. In one embodiment the antibody or fragment thereof comprises a CDRL1, a CDRL2, a CDRL3, a CDRH1, a CDRH2, and a CDRH3, wherein each CDRL1, CDRL2, CDRL3, CDRH1, CDRH2, and CDRH3, respectively, is encoded by a sequence selected from the group consisting of SEQ ID NO: 2199, SEQ ID NO: 2356, SEQ ID NO: 2513, SEQ ID NO: 2670, SEQ ID NO: 2827, and SEQ ID NO: 2984; SEQ ID NO: 2200, SEQ ID NO: 2357, SEQ ID NO: 2514, SEQ ID NO: 2671, SEQ ID NO: 2828, and SEQ ID NO: 2985; SEQ ID NO: 2201, SEQ ID NO: 2358, SEQ ID NO: 2515, SEQ ID NO: 2672, SEQ ID NO: 2829, and SEQ ID NO: 2986; SEQ ID NO: 2202, SEQ ID NO: 2359, SEQ ID NO: 2516, SEQ ID NO: 2673, SEQ ID NO: 2830, and SEQ ID NO: 2987; SEQ ID NO: 2203, SEQ ID NO: 2360, SEQ ID NO: 2517, SEQ ID NO: 2674, SEQ ID NO: 2831, and SEQ ID NO: 2988; SEQ ID NO: 2204, SEQ ID NO: 2361, SEQ ID NO: 2518, SEQ ID NO: 2675, SEQ ID NO: 2832, and SEQ ID NO: 2989; SEQ ID NO: 2205, SEQ ID NO: 2362, SEQ ID NO: 2519, SEQ ID NO: 2676, SEQ ID NO: 2833, and SEQ ID NO: 2990; SEQ ID NO: 2206, SEQ ID NO: 2363, SEQ ID NO: 2520, SEQ ID NO: 2677, SEQ ID NO: 2834, and SEQ ID NO: 2991; SEQ ID NO: 2207, SEQ ID NO: 2364, SEQ ID NO: 2521, SEQ ID NO: 2678, SEQ ID NO: 2835, and SEQ ID NO: 2992; SEQ ID NO: 2208, SEQ ID NO: 2365, SEQ ID NO: 2522, SEQ ID NO: 2679, SEQ ID NO: 2836, and SEQ ID NO: 2993; SEQ ID NO: 2209, SEQ ID NO: 2366, SEQ ID NO: 2523, SEQ ID NO: 2680, SEQ ID NO: 2837, and SEQ ID NO: 2994; SEQ ID NO: 2210, SEQ ID NO: 2367, SEQ ID NO: 2524, SEQ ID NO: 2681, SEQ ID NO: 2838, and SEQ ID NO: 2995; SEQ ID NO: 2211, SEQ ID NO: 2368, SEQ ID NO: 2525, SEQ ID NO: 2682, SEQ ID NO: 2839, and SEQ ID NO: 2996; SEQ ID NO: 2212, SEQ ID NO: 2369, SEQ ID NO: 2526, SEQ ID NO: 2683, SEQ ID NO: 2840, and SEQ ID NO: 2997; SEQ ID NO: 2213, SEQ ID NO: 2370, SEQ ID NO: 2527, SEQ ID NO: 2684, SEQ ID NO: 2841, and SEQ ID NO: 2998; SEQ ID NO: 2214, SEQ ID NO: 2371, SEQ ID NO: 2528, SEQ ID NO: 2685, SEQ ID NO: 2842, and SEQ ID NO: 2999; SEQ ID NO: 2215, SEQ ID NO: 2372, SEQ ID NO: 2529, SEQ ID NO: 2686, SEQ ID NO: 2843, and SEQ ID NO: 3000; SEQ ID NO: 2216, SEQ ID NO: 2373, SEQ ID NO: 2530, SEQ ID NO: 2687, SEQ ID NO: 2844, and SEQ ID NO: 3001; SEQ ID NO: 2217, SEQ ID NO: 2374, SEQ ID NO: 2531, SEQ ID NO: 2688, SEQ ID NO: 2845, and SEQ ID NO: 3002; SEQ ID NO: 2218, SEQ ID NO: 2375, SEQ ID NO: 2532, SEQ ID NO: 2689, SEQ ID NO: 2846, and SEQ ID NO: 3003; SEQ ID NO: 2219, SEQ ID NO: 2376, SEQ ID NO: 2533, SEQ ID NO: 2690, SEQ ID NO: 2847, and SEQ ID NO: 3004; SEQ ID NO: 2220, SEQ ID NO: 2377, SEQ ID NO: 2534, SEQ ID NO: 2691, SEQ ID NO: 2848, and SEQ ID NO: 3005; SEQ ID NO: 2221, SEQ ID NO: 2378, SEQ ID NO: 2535, SEQ ID NO: 2692, SEQ ID NO: 2849, and SEQ ID NO: 3006; SEQ ID NO: 2222, SEQ ID NO: 2379, SEQ ID NO: 2536, SEQ ID NO: 2693, SEQ ID NO: 2850, and SEQ ID NO: 3007; SEQ ID NO: 2223, SEQ ID NO: 2380, SEQ ID NO: 2537, SEQ ID NO: 2694, SEQ ID NO: 2851, and SEQ ID NO: 3008; SEQ ID NO: 2224, SEQ ID NO: 2381, SEQ ID NO: 2538, SEQ ID NO: 2695, SEQ ID NO: 2852, and SEQ ID NO: 3009; SEQ ID NO: 2225, SEQ ID NO: 2382, SEQ ID NO: 2539, SEQ ID NO: 2696, SEQ ID NO: 2853, and SEQ ID NO: 3010; SEQ ID NO: 2226, SEQ ID NO: 2383, SEQ ID NO: 2540, SEQ ID NO: 2697, SEQ ID NO: 2854, and SEQ ID NO: 3011; SEQ ID NO: 2227, SEQ ID NO: 2384, SEQ ID NO: 2541, SEQ ID NO: 2698, SEQ ID NO: 2855, and SEQ ID NO: 3012; SEQ ID NO: 2228, SEQ ID NO: 2385, SEQ ID NO: 2542, SEQ ID NO: 2699, SEQ ID NO: 2856, and SEQ ID NO: 3013; SEQ ID NO: 2229, SEQ ID NO: 2386, SEQ ID NO: 2543, SEQ ID NO: 2700, SEQ ID NO: 2857, and SEQ ID NO: 3014; SEQ ID NO: 2230, SEQ ID NO: 2387, SEQ ID NO: 2544, SEQ ID NO: 2701, SEQ ID NO: 2858, and SEQ ID NO: 3015; SEQ ID NO: 2231, SEQ ID NO: 2388, SEQ ID NO: 2545, SEQ ID NO: 2702, SEQ ID NO: 2859, and SEQ ID NO: 3016; SEQ ID NO: 2232, SEQ ID NO: 2389, SEQ ID NO: 2546, SEQ ID NO: 2703, SEQ ID NO: 2860, and SEQ ID NO: 3017; SEQ ID NO: 2233, SEQ ID NO: 2390, SEQ ID NO: 2547, SEQ ID NO: 2704, SEQ ID NO: 2861, and SEQ ID NO: 3018; SEQ ID NO: 2234, SEQ ID NO: 2391, SEQ ID NO: 2548, SEQ ID NO: 2705, SEQ ID NO: 2862, and SEQ ID NO: 3019; SEQ ID NO: 2235, SEQ ID NO: 2392, SEQ ID NO: 2549, SEQ ID NO: 2706, SEQ ID NO: 2863, and SEQ ID NO: 3020; SEQ ID NO: 2236, SEQ ID NO: 2393, SEQ ID NO: 2550, SEQ ID NO: 2707, SEQ ID NO: 2864, and SEQ ID NO: 3021; SEQ ID NO: 2237, SEQ ID NO: 2394, SEQ ID NO: 2551, SEQ ID NO: 2708, SEQ ID NO: 2865, and SEQ ID NO: 3022; SEQ ID NO: 2238, SEQ ID NO: 2395, SEQ ID NO: 2552, SEQ ID NO: 2709, SEQ ID NO: 2866, and SEQ ID NO: 3023; SEQ ID NO: 2239, SEQ ID NO: 2396, SEQ ID NO: 2553, SEQ ID NO: 2710, SEQ ID NO: 2867, and SEQ ID NO: 3024; SEQ ID NO: 2240, SEQ ID NO: 2397, SEQ ID NO: 2554, SEQ ID NO: 2711, SEQ ID NO: 2868, and SEQ ID NO: 3025; SEQ ID NO: 2241, SEQ ID NO: 2398, SEQ ID NO: 2555, SEQ ID NO: 2712, SEQ ID NO: 2869, and SEQ ID NO: 3026; SEQ ID NO: 2242, SEQ ID NO: 2399, SEQ ID NO: 2556, SEQ ID NO: 2713, SEQ ID NO: 2870, and SEQ ID NO: 3027; SEQ ID NO: 2243, SEQ ID NO: 2400, SEQ ID NO: 2557, SEQ ID NO: 2714, SEQ ID NO: 2871, and SEQ ID NO: 3028; SEQ ID NO: 2244, SEQ ID NO: 2401, SEQ ID NO: 2558, SEQ ID NO: 2715, SEQ ID NO: 2872, and SEQ ID NO: 3029; SEQ ID NO: 2245, SEQ ID NO: 2402, SEQ ID NO: 2559, SEQ ID NO: 2716, SEQ ID NO: 2873, and SEQ ID NO: 3030; SEQ ID NO: 2246, SEQ ID NO: 2403, SEQ ID NO: 2560, SEQ ID NO: 2717, SEQ ID NO: 2874, and SEQ ID NO: 3031; SEQ ID NO: 2247, SEQ ID NO: 2404, SEQ ID NO: 2561, SEQ ID NO: 2718, SEQ ID NO: 2875, and SEQ ID NO: 3032; SEQ ID NO: 2248, SEQ ID NO: 2405, SEQ ID NO: 2562, SEQ ID NO: 2719, SEQ ID NO: 2876, and SEQ ID NO: 3033; SEQ ID NO: 2249, SEQ ID NO: 2406, SEQ ID NO: 2563, SEQ ID NO: 2720, SEQ ID NO: 2877, and SEQ ID NO: 3034; SEQ ID NO: 2250, SEQ ID NO: 2407, SEQ ID NO: 2564, SEQ ID NO: 2721, SEQ ID NO: 2878, and SEQ ID NO: 3035; SEQ ID NO: 2251, SEQ ID NO: 2408, SEQ ID NO: 2565, SEQ ID NO: 2722, SEQ ID NO: 2879, and SEQ ID NO: 3036; SEQ ID NO: 2252, SEQ ID NO: 2409, SEQ ID NO: 2566, SEQ ID NO: 2723, SEQ ID NO: 2880, and SEQ ID NO: 3037; SEQ ID NO: 2253, SEQ ID NO: 2410, SEQ ID NO: 2567, SEQ ID NO: 2724, SEQ ID NO: 2881, and SEQ ID NO: 3038; SEQ ID NO: 2254, SEQ ID NO: 2411, SEQ ID NO: 2568, SEQ ID NO: 2725, SEQ ID NO: 2882, and SEQ ID NO: 3039; SEQ ID NO: 2255, SEQ ID NO: 2412, SEQ ID NO: 2569, SEQ ID NO: 2726, SEQ ID NO: 2883, and SEQ ID NO: 3040; SEQ ID NO: 2256, SEQ ID NO: 2413, SEQ ID NO: 2570, SEQ ID NO: 2727, SEQ ID NO: 2884, and SEQ ID NO: 3041; SEQ ID NO: 2257, SEQ ID NO: 2414, SEQ ID NO: 2571, SEQ ID NO: 2728, SEQ ID NO: 2885, and SEQ ID NO: 3042; SEQ ID NO: 2258, SEQ ID NO: 2415, SEQ ID NO: 2572, SEQ ID NO: 2729, SEQ ID NO: 2886, and SEQ ID NO: 3043; SEQ ID NO: 2259, SEQ ID NO: 2416, SEQ ID NO: 2573, SEQ ID NO: 2730, SEQ ID NO: 2887, and SEQ ID NO: 3044; SEQ ID NO: 2260, SEQ ID NO: 2417, SEQ ID NO: 2574, SEQ ID NO: 2731, SEQ ID NO: 2888, and SEQ ID NO: 3045; SEQ ID NO: 2261, SEQ ID NO: 2418, SEQ ID NO: 2575, SEQ ID NO: 2732, SEQ ID NO: 2889, and SEQ ID NO: 3046; SEQ ID NO: 2262, SEQ ID NO: 2419, SEQ ID NO: 2576, SEQ ID NO: 2733, SEQ ID NO: 2890, and SEQ ID NO: 3047; SEQ ID NO: 2263, SEQ ID NO: 2420, SEQ ID NO: 2577, SEQ ID NO: 2734, SEQ ID NO: 2891, and SEQ ID NO: 3048; SEQ ID NO: 2264, SEQ ID NO: 2421, SEQ ID NO: 2578, SEQ ID NO: 2735, SEQ ID NO: 2892, and SEQ ID NO: 3049; SEQ ID NO: 2265, SEQ ID NO: 2422, SEQ ID NO: 2579, SEQ ID NO: 2736, SEQ ID NO: 2893, and SEQ ID NO: 3050; SEQ ID NO: 2266, SEQ ID NO: 2423, SEQ ID NO: 2580, SEQ ID NO: 2737, SEQ ID NO: 2894, and SEQ ID NO: 3051; SEQ ID NO: 2267, SEQ ID NO: 2424, SEQ ID NO: 2581, SEQ ID NO: 2738, SEQ ID NO: 2895, and SEQ ID NO: 3052; SEQ ID NO: 2268, SEQ ID NO: 2425, SEQ ID NO: 2582, SEQ ID NO: 2739, SEQ ID NO: 2896, and SEQ ID NO: 3053; SEQ ID NO: 2269, SEQ ID NO: 2426, SEQ ID NO: 2583, SEQ ID NO: 2740, SEQ ID NO: 2897, and SEQ ID NO: 3054; SEQ ID NO: 2270, SEQ ID NO: 2427, SEQ ID NO: 2584, SEQ ID NO: 2741, SEQ ID NO: 2898, and SEQ ID NO: 3055; SEQ ID NO: 2271, SEQ ID NO: 2428, SEQ ID NO: 2585, SEQ ID NO: 2742, SEQ ID NO: 2899, and SEQ ID NO: 3056; SEQ ID NO: 2272, SEQ ID NO: 2429, SEQ ID NO: 2586, SEQ ID NO: 2743, SEQ ID NO: 2900, and SEQ ID NO: 3057; SEQ ID NO: 2273, SEQ ID NO: 2430, SEQ ID NO: 2587, SEQ ID NO: 2744, SEQ ID NO: 2901, and SEQ ID NO: 3058; SEQ ID NO: 2274, SEQ ID NO: 2431, SEQ ID NO: 2588, SEQ ID NO: 2745, SEQ ID NO: 2902, and SEQ ID NO: 3059; SEQ ID NO: 2275, SEQ ID NO: 2432, SEQ ID NO: 2589, SEQ ID NO: 2746, SEQ ID NO: 2903, and SEQ ID NO: 3060; SEQ ID NO: 2276, SEQ ID NO: 2433, SEQ ID NO: 2590, SEQ ID NO: 2747, SEQ ID NO: 2904, and SEQ ID NO: 3061; SEQ ID NO: 2277, SEQ ID NO: 2434, SEQ ID NO: 2591, SEQ ID NO: 2748, SEQ ID NO: 2905, and SEQ ID NO: 3062; SEQ ID NO: 2278, SEQ ID NO: 2435, SEQ ID NO: 2592, SEQ ID NO: 2749, SEQ ID NO: 2906, and SEQ ID NO: 3063; SEQ ID NO: 2279, SEQ ID NO: 2436, SEQ ID NO: 2593, SEQ ID NO: 2750, SEQ ID NO: 2907, and SEQ ID NO: 3064; SEQ ID NO: 2280, SEQ ID NO: 2437, SEQ ID NO: 2594, SEQ ID NO: 2751, SEQ ID NO: 2908, and SEQ ID NO: 3065; SEQ ID NO: 2281, SEQ ID NO: 2438, SEQ ID NO: 2595, SEQ ID NO: 2752, SEQ ID NO: 2909, and SEQ ID NO: 3066; SEQ ID NO: 2282, SEQ ID NO: 2439, SEQ ID NO: 2596, SEQ ID NO: 2753, SEQ ID NO: 2910, and SEQ ID NO: 3067; SEQ ID NO: 2283, SEQ ID NO: 2440, SEQ ID NO: 2597, SEQ ID NO: 2754, SEQ ID NO: 2911, and SEQ ID NO: 3068; SEQ ID NO: 2284, SEQ ID NO: 2441, SEQ ID NO: 2598, SEQ ID NO: 2755, SEQ ID NO: 2912, and SEQ ID NO: 3069; SEQ ID NO: 2285, SEQ ID NO: 2442, SEQ ID NO: 2599, SEQ ID NO: 2756, SEQ ID NO: 2913, and SEQ ID NO: 3070; SEQ ID NO: 2286, SEQ ID NO: 2443, SEQ ID NO: 2600, SEQ ID NO: 2757, SEQ ID NO: 2914, and SEQ ID NO: 3071; SEQ ID NO: 2287, SEQ ID NO: 2444, SEQ ID NO: 2601, SEQ ID NO: 2758, SEQ ID NO: 2915, and SEQ ID NO: 3072; SEQ ID NO: 2288, SEQ ID NO: 2445, SEQ ID NO: 2602, SEQ ID NO: 2759, SEQ ID NO: 2916, and SEQ ID NO: 3073; SEQ ID NO: 2289, SEQ ID NO: 2446, SEQ ID NO: 2603, SEQ ID NO: 2760, SEQ ID NO: 2917, and SEQ ID NO: 3074; SEQ ID NO: 2290, SEQ ID NO: 2447, SEQ ID NO: 2604, SEQ ID NO: 2761, SEQ ID NO: 2918, and SEQ ID NO: 3075; SEQ ID NO: 2291, SEQ ID NO: 2448, SEQ ID NO: 2605, SEQ ID NO: 2762, SEQ ID NO: 2919, and SEQ ID NO: 3076; SEQ ID NO: 2292, SEQ ID NO: 2449, SEQ ID NO: 2606, SEQ ID NO: 2763, SEQ ID NO: 2920, and SEQ ID NO: 3077; SEQ ID NO: 2293, SEQ ID NO: 2450, SEQ ID NO: 2607, SEQ ID NO: 2764, SEQ ID NO: 2921, and SEQ ID NO: 3078; SEQ ID NO: 2294, SEQ ID NO: 2451, SEQ ID NO: 2608, SEQ ID NO: 2765, SEQ ID NO: 2922, and SEQ ID NO: 3079; SEQ ID NO: 2295, SEQ ID NO: 2452, SEQ ID NO: 2609, SEQ ID NO: 2766, SEQ ID NO: 2923, and SEQ ID NO: 3080; SEQ ID NO: 2296, SEQ ID NO: 2453, SEQ ID NO: 2610, SEQ ID NO: 2767, SEQ ID NO: 2924, and SEQ ID NO: 3081; SEQ ID NO: 2297, SEQ ID NO: 2454, SEQ ID NO: 2611, SEQ ID NO: 2768, SEQ ID NO: 2925, and SEQ ID NO: 3082; SEQ ID NO: 2298, SEQ ID NO: 2455, SEQ ID NO: 2612, SEQ ID NO: 2769, SEQ ID NO: 2926, and SEQ ID NO: 3083; SEQ ID NO: 2299, SEQ ID NO: 2456, SEQ ID NO: 2613, SEQ ID NO: 2770, SEQ ID NO: 2927, and SEQ ID NO: 3084; SEQ ID NO: 2300, SEQ ID NO: 2457, SEQ ID NO: 2614, SEQ ID NO: 2771, SEQ ID NO: 2928, and SEQ ID NO: 3085; SEQ ID NO: 2301, SEQ ID NO: 2458, SEQ ID NO: 2615, SEQ ID NO: 2772, SEQ ID NO: 2929, and SEQ ID NO: 3086; SEQ ID NO: 2302, SEQ ID NO: 2459, SEQ ID NO: 2616, SEQ ID NO: 2773, SEQ ID NO: 2930, and SEQ ID NO: 3087; SEQ ID NO: 2303, SEQ ID NO: 2460, SEQ ID NO: 2617, SEQ ID NO: 2774, SEQ ID NO: 2931, and SEQ ID NO: 3088; SEQ ID NO: 2304, SEQ ID NO: 2461, SEQ ID NO: 2618, SEQ ID NO: 2775, SEQ ID NO: 2932, and SEQ ID NO: 3089; SEQ ID NO: 2305, SEQ ID NO: 2462, SEQ ID NO: 2619, SEQ ID NO: 2776, SEQ ID NO: 2933, and SEQ ID NO: 3090; SEQ ID NO: 2306, SEQ ID NO: 2463, SEQ ID NO: 2620, SEQ ID NO: 2777, SEQ ID NO: 2934, and SEQ ID NO: 3091; SEQ ID NO: 2307, SEQ ID NO: 2464, SEQ ID NO: 2621, SEQ ID NO: 2778, SEQ ID NO: 2935, and SEQ ID NO: 3092; SEQ ID NO: 2308, SEQ ID NO: 2465, SEQ ID NO: 2622, SEQ ID NO: 2779, SEQ ID NO: 2936, and SEQ ID NO: 3093; SEQ ID NO: 2309, SEQ ID NO: 2466, SEQ ID NO: 2623, SEQ ID NO: 2780, SEQ ID NO: 2937, and SEQ ID NO: 3094; SEQ ID NO: 2310, SEQ ID NO: 2467, SEQ ID NO: 2624, SEQ ID NO: 2781, SEQ ID NO: 2938, and SEQ ID NO: 3095; SEQ ID NO: 2311, SEQ ID NO: 2468, SEQ ID NO: 2625, SEQ ID NO: 2782, SEQ ID NO: 2939, and SEQ ID NO: 3096; SEQ ID NO: 2312, SEQ ID NO: 2469, SEQ ID NO: 2626, SEQ ID NO: 2783, SEQ ID NO: 2940, and SEQ ID NO: 3097; SEQ ID NO: 2313, SEQ ID NO: 2470, SEQ ID NO: 2627, SEQ ID NO: 2784, SEQ ID NO: 2941, and SEQ ID NO: 3098; SEQ ID NO: 2314, SEQ ID NO: 2471, SEQ ID NO: 2628, SEQ ID NO: 2785, SEQ ID NO: 2942, and SEQ ID NO: 3099; SEQ ID NO: 2315, SEQ ID NO: 2472, SEQ ID NO: 2629, SEQ ID NO: 2786, SEQ ID NO: 2943, and SEQ ID NO: 3100; SEQ ID NO: 2316, SEQ ID NO: 2473, SEQ ID NO: 2630, SEQ ID NO: 2787, SEQ ID NO: 2944, and SEQ ID NO: 3101; SEQ ID NO: 2317, SEQ ID NO: 2474, SEQ ID NO: 2631, SEQ ID NO: 2788, SEQ ID NO: 2945, and SEQ ID NO: 3102; SEQ ID NO: 2318, SEQ ID NO: 2475, SEQ ID NO: 2632, SEQ ID NO: 2789, SEQ ID NO: 2946, and SEQ ID NO: 3103; SEQ ID NO: 2319, SEQ ID NO: 2476, SEQ ID NO: 2633, SEQ ID NO: 2790, SEQ ID NO: 2947, and SEQ ID NO: 3104; SEQ ID NO: 2320, SEQ ID NO: 2477, SEQ ID NO: 2634, SEQ ID NO: 2791, SEQ ID NO: 2948, and SEQ ID NO: 3105; SEQ ID NO: 2321, SEQ ID NO: 2478, SEQ ID NO: 2635, SEQ ID NO: 2792, SEQ ID NO: 2949, and SEQ ID NO: 3106; SEQ ID NO: 2322, SEQ ID NO: 2479, SEQ ID NO: 2636, SEQ ID NO: 2793, SEQ ID NO: 2950, and SEQ ID NO: 3107; SEQ ID NO: 2323, SEQ ID NO: 2480, SEQ ID NO: 2637, SEQ ID NO: 2794, SEQ ID NO: 2951, and SEQ ID NO: 3108; SEQ ID NO: 2324, SEQ ID NO: 2481, SEQ ID NO: 2638, SEQ ID NO: 2795, SEQ ID NO: 2952, and SEQ ID NO: 3109; SEQ ID NO: 2325, SEQ ID NO: 2482, SEQ ID NO: 2639, SEQ ID NO: 2796, SEQ ID NO: 2953, and SEQ ID NO: 3110; SEQ ID NO: 2326, SEQ ID NO: 2483, SEQ ID NO: 2640, SEQ ID NO: 2797, SEQ ID NO: 2954, and SEQ ID NO: 3111; SEQ ID NO: 2327, SEQ ID NO: 2484, SEQ ID NO: 2641, SEQ ID NO: 2798, SEQ ID NO: 2955, and SEQ ID NO: 3112; SEQ ID NO: 2328, SEQ ID NO: 2485, SEQ ID NO: 2642, SEQ ID NO: 2799, SEQ ID NO: 2956, and SEQ ID NO: 3113; SEQ ID NO: 2329, SEQ ID NO: 2486, SEQ ID NO: 2643, SEQ ID NO: 2800, SEQ ID NO: 2957, and SEQ ID NO: 3114; SEQ ID NO: 2330, SEQ ID NO: 2487, SEQ ID NO: 2644, SEQ ID NO: 2801, SEQ ID NO: 2958, and SEQ ID NO: 3115; SEQ ID NO: 2331, SEQ ID NO: 2488, SEQ ID NO: 2645, SEQ ID NO: 2802, SEQ ID NO: 2959, and SEQ ID NO: 3116; SEQ ID NO: 2332, SEQ ID NO: 2489, SEQ ID NO: 2646, SEQ ID NO: 2803, SEQ ID NO: 2960, and SEQ ID NO: 3117; SEQ ID NO: 2333, SEQ ID NO: 2490, SEQ ID NO: 2647, SEQ ID NO: 2804, SEQ ID NO: 2961, and SEQ ID NO: 3118; SEQ ID NO: 2334, SEQ ID NO: 2491, SEQ ID NO: 2648, SEQ ID NO: 2805, SEQ ID NO: 2962, and SEQ ID NO: 3119; SEQ ID NO: 2335, SEQ ID NO: 2492, SEQ ID NO: 2649, SEQ ID NO: 2806, SEQ ID NO: 2963, and SEQ ID NO: 3120; SEQ ID NO: 2336, SEQ ID NO: 2493, SEQ ID NO: 2650, SEQ ID NO: 2807, SEQ ID NO: 2964, and SEQ ID NO: 3121; SEQ ID NO: 2337, SEQ ID NO: 2494, SEQ ID NO: 2651, SEQ ID NO: 2808, SEQ ID NO: 2965, and SEQ ID NO: 3122; SEQ ID NO: 2338, SEQ ID NO: 2495, SEQ ID NO: 2652, SEQ ID NO: 2809, SEQ ID NO: 2966, and SEQ ID NO: 3123; SEQ ID NO: 2339, SEQ ID NO: 2496, SEQ ID NO: 2653, SEQ ID NO: 2810, SEQ ID NO: 2967, and SEQ ID NO: 3124; SEQ ID NO: 2340, SEQ ID NO: 2497, SEQ ID NO: 2654, SEQ ID NO: 2811, SEQ ID NO: 2968, and SEQ ID NO: 3125; SEQ ID NO: 2341, SEQ ID NO: 2498, SEQ ID NO: 2655, SEQ ID NO: 2812, SEQ ID NO: 2969, and SEQ ID NO: 3126; SEQ ID NO: 2342, SEQ ID NO: 2499, SEQ ID NO: 2656, SEQ ID NO: 2813, SEQ ID NO: 2970, and SEQ ID NO: 3127; SEQ ID NO: 2343, SEQ ID NO: 2500, SEQ ID NO: 2657, SEQ ID NO: 2814, SEQ ID NO: 2971, and SEQ ID NO: 3128; SEQ ID NO: 2344, SEQ ID NO: 2501, SEQ ID NO: 2658, SEQ ID NO: 2815, SEQ ID NO: 2972, and SEQ ID NO: 3129; SEQ ID NO: 2345, SEQ ID NO: 2502, SEQ ID NO: 2659, SEQ ID NO: 2816, SEQ ID NO: 2973, and SEQ ID NO: 3130; SEQ ID NO: 2346, SEQ ID NO: 2503, SEQ ID NO: 2660, SEQ ID NO: 2817, SEQ ID NO: 2974, and SEQ ID NO: 3131; SEQ ID NO: 2347, SEQ ID NO: 2504, SEQ ID NO: 2661, SEQ ID NO: 2818, SEQ ID NO: 2975, and SEQ ID NO: 3132; SEQ ID NO: 2348, SEQ ID NO: 2505, SEQ ID NO: 2662, SEQ ID NO: 2819, SEQ ID NO: 2976, and SEQ ID NO: 3133; SEQ ID NO: 2349, SEQ ID NO: 2506, SEQ ID NO: 2663, SEQ ID NO: 2820, SEQ ID NO: 2977, and SEQ ID NO: 3134; SEQ ID NO: 2350, SEQ ID NO: 2507, SEQ ID NO: 2664, SEQ ID NO: 2821, SEQ ID NO: 2978, and SEQ ID NO: 3135; SEQ ID NO: 2351, SEQ ID NO: 2508, SEQ ID NO: 2665, SEQ ID NO: 2822, SEQ ID NO: 2979, and SEQ ID NO: 3136; SEQ ID NO: 2352, SEQ ID NO: 2509, SEQ ID NO: 2666, SEQ ID NO: 2823, SEQ ID NO: 2980, and SEQ ID NO: 3137; SEQ ID NO: 2353, SEQ ID NO: 2510, SEQ ID NO: 2667, SEQ ID NO: 2824, SEQ ID NO: 2981, and SEQ ID NO: 3138; SEQ ID NO: 2354, SEQ ID NO: 2511, SEQ ID NO: 2668, SEQ ID NO: 2825, SEQ ID NO: 2982, and SEQ ID NO: 3139; and SEQ ID NO: 2355, SEQ ID NO: 2512, SEQ ID NO: 2669, SEQ ID NO: 2826, SEQ ID NO: 2983, and SEQ ID NO: 3140.

In another aspect, an antigen binding protein includes 1, 2, 3, 4, 5, or 6 variant forms of the CDRs listed in TABLES 4A and 4B, each having at least 80%, 85%, 90%, 95%, 96%, 97%, 98%, or 99% sequence identity to a CDR sequence listed in TABLES 4A and 4B. Some antigen binding proteins include 1, 2, 3, 4, 5, or 6 of the CDRs listed in TABLES 4A and 4B, each or collectively differing by no more than 1, 2, 3, 4 or 5 amino acids from the CDRs listed in this table.

In various other embodiments, the antigen binding protein is derived from such antibodies. For instance, in one aspect, the antigen binding protein comprises 1, 2, 3, 4, 5 or all 6 of the CDRs listed in one of the rows for any particular antibody listed in TABLES 4A and 4B. In another aspect, an antigen binding protein includes 1, 2, 3, 4, 5, or 6 variant forms of the CDRs listed in one of the rows for an antibody in TABLES 4A and 4B, each CDR having at least 80%, 85%, 90%, 95%, 96%, 97%, 98%, or 99% sequence identity to a CDR sequence listed in TABLES 4A and 4B. Some antigen binding proteins include 1, 2, 3, 4, 5, or 6 of the CDRs listed in one of the rows of TABLES 4A and 4B, each differing by no more than 1, 2, 3, 4 or 5 amino acids from the CDRs listed in these tables. In another aspect, the antigen binding protein comprises all 6 of the CDRS listed in a row of TABLES 4A and 4B and the total number of amino acid changes to the CDRs collectively is no more than 1, 2, 3, 4, or 5 amino acids.

In one embodiment the antibody or fragment thereof comprises a light chain comprising a sequence selected from the group consisting of SEQ ID NOs: 472-628. In one embodiment the antibody or fragment thereof comprises a heavy chain comprising a sequence selected from the group consisting of SEQ ID NOs: 472-628. In one embodiment the antibody or fragment thereof comprises a light chain comprising a sequence selected from the group consisting of SEQ ID NOs: 472-628 and a heavy chain comprising a sequence selected from the group consisting of SEQ ID NOs: 472-628. In one embodiment the antibody or fragment thereof comprises a combination of a light chain and a heavy chain selected from the group consisting of a light chain comprising SEQ ID NO: 315 and a heavy chain comprising SEQ ID NO: 472; a light chain comprising SEQ ID NO: 316 and a heavy chain comprising SEQ ID NO: 473; a light chain comprising SEQ ID NO: 317 and a heavy chain comprising SEQ ID NO: 474; a light chain comprising SEQ ID NO: 318 and a heavy chain comprising SEQ ID NO: 475; a light chain comprising SEQ ID NO: 319 and a heavy chain comprising SEQ ID NO: 476; a light chain comprising SEQ ID NO: 320 and a heavy chain comprising SEQ ID NO: 477; a light chain comprising SEQ ID NO: 321 and a heavy chain comprising SEQ ID NO: 478; a light chain comprising SEQ ID NO: 322 and a heavy chain comprising SEQ ID NO: 479; a light chain comprising SEQ ID NO: 323 and a heavy chain comprising SEQ ID NO: 480; a light chain comprising SEQ ID NO: 324 and a heavy chain comprising SEQ ID NO: 481; a light chain comprising SEQ ID NO: 325 and a heavy chain comprising SEQ ID NO: 482; a light chain comprising SEQ ID NO: 326 and a heavy chain comprising SEQ ID NO: 483; a light chain comprising SEQ ID NO: 327 and a heavy chain comprising SEQ ID NO: 484; a light chain comprising SEQ ID NO: 328 and a heavy chain comprising SEQ ID NO: 485; a light chain comprising SEQ ID NO: 329 and a heavy chain comprising SEQ ID NO: 486; a light chain comprising SEQ ID NO: 330 and a heavy chain comprising SEQ ID NO: 487; a light chain comprising SEQ ID NO: 331 and a heavy chain comprising SEQ ID NO: 488; a light chain comprising SEQ ID NO: 332 and a heavy chain comprising SEQ ID NO: 489; a light chain comprising SEQ ID NO: 333 and a heavy chain comprising SEQ ID NO: 490; a light chain comprising SEQ ID NO: 334 and a heavy chain comprising SEQ ID NO: 491; a light chain comprising SEQ ID NO: 335 and a heavy chain comprising SEQ ID NO: 492; a light chain comprising SEQ ID NO: 336 and a heavy chain comprising SEQ ID NO: 493; a light chain comprising SEQ ID NO: 337 and a heavy chain comprising SEQ ID NO: 494; a light chain comprising SEQ ID NO: 338 and a heavy chain comprising SEQ ID NO: 495; a light chain comprising SEQ ID NO: 339 and a heavy chain comprising SEQ ID NO: 496; a light chain comprising SEQ ID NO: 340 and a heavy chain comprising SEQ ID NO: 497; a light chain comprising SEQ ID NO: 341 and a heavy chain comprising SEQ ID NO: 498; a light chain comprising SEQ ID NO: 342 and a heavy chain comprising SEQ ID NO: 499; a light chain comprising SEQ ID NO: 343 and a heavy chain comprising SEQ ID NO: 500; a light chain comprising SEQ ID NO: 344 and a heavy chain comprising SEQ ID NO: 501; a light chain comprising SEQ ID NO: 345 and a heavy chain comprising SEQ ID NO: 502; a light chain comprising SEQ ID NO: 346 and a heavy chain comprising SEQ ID NO: 503; a light chain comprising SEQ ID NO: 347 and a heavy chain comprising SEQ ID NO: 504; a light chain comprising SEQ ID NO: 348 and a heavy chain comprising SEQ ID NO: 505; a light chain comprising SEQ ID NO: 349 and a heavy chain comprising SEQ ID NO: 506; a light chain comprising SEQ ID NO: 350 and a heavy chain comprising SEQ ID NO: 507; a light chain comprising SEQ ID NO: 351 and a heavy chain comprising SEQ ID NO: 508; a light chain comprising SEQ ID NO: 352 and a heavy chain comprising SEQ ID NO: 509; a light chain comprising SEQ ID NO: 353 and a heavy chain comprising SEQ ID NO: 510; a light chain comprising SEQ ID NO: 354 and a heavy chain comprising SEQ ID NO: 511; a light chain comprising SEQ ID NO: 355 and a heavy chain comprising SEQ ID NO: 512; a light chain comprising SEQ ID NO: 356 and a heavy chain comprising SEQ ID NO: 513; a light chain comprising SEQ ID NO: 357 and a heavy chain comprising SEQ ID NO: 514; a light chain comprising SEQ ID NO: 358 and a heavy chain comprising SEQ ID NO: 515; a light chain comprising SEQ ID NO: 359 and a heavy chain comprising SEQ ID NO: 516; a light chain comprising SEQ ID NO: 360 and a heavy chain comprising SEQ ID NO: 517; a light chain comprising SEQ ID NO: 361 and a heavy chain comprising SEQ ID NO: 518; a light chain comprising SEQ ID NO: 362 and a heavy chain comprising SEQ ID NO: 519; a light chain comprising SEQ ID NO: 363 and a heavy chain comprising SEQ ID NO: 520; a light chain comprising SEQ ID NO: 364 and a heavy chain comprising SEQ ID NO: 521; a light chain comprising SEQ ID NO: 365 and a heavy chain comprising SEQ ID NO: 522; a light chain comprising SEQ ID NO: 366 and a heavy chain comprising SEQ ID NO: 523; a light chain comprising SEQ ID NO: 367 and a heavy chain comprising SEQ ID NO: 524; a light chain comprising SEQ ID NO: 368 and a heavy chain comprising SEQ ID NO: 525; a light chain comprising SEQ ID NO: 369 and a heavy chain comprising SEQ ID NO: 526; a light chain comprising SEQ ID NO: 370 and a heavy chain comprising SEQ ID NO: 527; a light chain comprising SEQ ID NO: 371 and a heavy chain comprising SEQ ID NO: 528; a light chain comprising SEQ ID NO: 372 and a heavy chain comprising SEQ ID NO: 529;

a light chain comprising SEQ ID NO: 373 and a heavy chain comprising SEQ ID NO: 530; a light chain comprising SEQ ID NO: 374 and a heavy chain comprising SEQ ID NO: 531; a light chain comprising SEQ ID NO: 375 and a heavy chain comprising SEQ ID NO: 532; a light chain comprising SEQ ID NO: 376 and a heavy chain comprising SEQ ID NO: 533; a light chain comprising SEQ ID NO: 377 and a heavy chain comprising SEQ ID NO: 534; a light chain comprising SEQ ID NO: 378 and a heavy chain comprising SEQ ID NO: 535; a light chain comprising SEQ ID NO: 379 and a heavy chain comprising SEQ ID NO: 536; a light chain comprising SEQ ID NO: 380 and a heavy chain comprising SEQ ID NO: 537; a light chain comprising SEQ ID NO: 381 and a heavy chain comprising SEQ ID NO: 538; a light chain comprising SEQ ID NO: 382 and a heavy chain comprising SEQ ID NO: 539; a light chain comprising SEQ ID NO: 383 and a heavy chain comprising SEQ ID NO: 540; a light chain comprising SEQ ID NO: 384 and a heavy chain comprising SEQ ID NO: 541; a light chain comprising SEQ ID NO: 385 and a heavy chain comprising SEQ ID NO: 542; a light chain comprising SEQ ID NO: 386 and a heavy chain comprising SEQ ID NO: 543; a light chain comprising SEQ ID NO: 387 and a heavy chain comprising SEQ ID NO: 544; a light chain comprising SEQ ID NO: 388 and a heavy chain comprising SEQ ID NO: 545; a light chain comprising SEQ ID NO: 389 and a heavy chain comprising SEQ ID NO: 546; a light chain comprising SEQ ID NO: 390 and a heavy chain comprising SEQ ID NO: 547; a light chain comprising SEQ ID NO: 391 and a heavy chain comprising SEQ ID NO: 548; a light chain comprising SEQ ID NO: 392 and a heavy chain comprising SEQ ID NO: 549; a light chain comprising SEQ ID NO: 393 and a heavy chain comprising SEQ ID NO: 550; a light chain comprising SEQ ID NO: 394 and a heavy chain comprising SEQ ID NO: 551; a light chain comprising SEQ ID NO: 395 and a heavy chain comprising SEQ ID NO: 552; a light chain comprising SEQ ID NO: 396 and a heavy chain comprising SEQ ID NO: 553; a light chain comprising SEQ ID NO: 397 and a heavy chain comprising SEQ ID NO: 554; a light chain comprising SEQ ID NO: 398 and a heavy chain comprising SEQ ID NO: 555; a light chain comprising SEQ ID NO: 399 and a heavy chain comprising SEQ ID NO: 556; a light chain comprising SEQ ID NO: 400 and a heavy chain comprising SEQ ID NO: 557; a light chain comprising SEQ ID NO: 401 and a heavy chain comprising SEQ ID NO: 558; a light chain comprising SEQ ID NO: 402 and a heavy chain comprising SEQ ID NO: 559; a light chain comprising SEQ ID NO: 403 and a heavy chain comprising SEQ ID NO: 560; a light chain comprising SEQ ID NO: 404 and a heavy chain comprising SEQ ID NO: 561; a light chain comprising SEQ ID NO: 405 and a heavy chain comprising SEQ ID NO: 562; a light chain comprising SEQ ID NO: 406 and a heavy chain comprising SEQ ID NO: 563; a light chain comprising SEQ ID NO: 407 and a heavy chain comprising SEQ ID NO: 564; a light chain comprising SEQ ID NO: 408 and a heavy chain comprising SEQ ID NO: 565; a light chain comprising SEQ ID NO: 409 and a heavy chain comprising SEQ ID NO: 566; a light chain comprising SEQ ID NO: 410 and a heavy chain comprising SEQ ID NO: 567; a light chain comprising SEQ ID NO: 411 and a heavy chain comprising SEQ ID NO: 568; a light chain comprising SEQ ID NO: 412 and a heavy chain comprising SEQ ID NO: 569; a light chain comprising SEQ ID NO: 413 and a heavy chain comprising SEQ ID NO: 570; a light chain comprising SEQ ID NO: 414 and a heavy chain comprising SEQ ID NO: 571; a light chain comprising SEQ ID NO: 415 and a heavy chain comprising SEQ ID NO: 572; a light chain comprising SEQ ID NO: 416 and a heavy chain comprising SEQ ID NO: 573; a light chain comprising SEQ ID NO: 417 and a heavy chain comprising SEQ ID NO: 574; a light chain comprising SEQ ID NO: 418 and a heavy chain comprising SEQ ID NO: 575; a light chain comprising SEQ ID NO: 419 and a heavy chain comprising SEQ ID NO: 576; a light chain comprising SEQ ID NO: 420 and a heavy chain comprising SEQ ID NO: 577; a light chain comprising SEQ ID NO: 421 and a heavy chain comprising SEQ ID NO: 578; a light chain comprising SEQ ID NO: 422 and a heavy chain comprising SEQ ID NO: 579; a light chain comprising SEQ ID NO: 423 and a heavy chain comprising SEQ ID NO: 580; a light chain comprising SEQ ID NO: 424 and a heavy chain comprising SEQ ID NO: 581; a light chain comprising SEQ ID NO: 425 and a heavy chain comprising SEQ ID NO: 582; a light chain comprising SEQ ID NO: 426 and a heavy chain comprising SEQ ID NO: 583; a light chain comprising SEQ ID NO: 427 and a heavy chain comprising SEQ ID NO: 584; a light chain comprising SEQ ID NO: 428 and a heavy chain comprising SEQ ID NO: 585; a light chain comprising SEQ ID NO: 429 and a heavy chain comprising SEQ ID NO: 586; a light chain comprising SEQ ID NO: 430 and a heavy chain comprising SEQ ID NO: 587; a light chain comprising SEQ ID NO: 431 and a heavy chain comprising SEQ ID NO: 588; a light chain comprising SEQ ID NO: 432 and a heavy chain comprising SEQ ID NO: 589; a light chain comprising SEQ ID NO: 433 and a heavy chain comprising SEQ ID NO: 590; a light chain comprising SEQ ID NO: 434 and a heavy chain comprising SEQ ID NO: 591; a light chain comprising SEQ ID NO: 435 and a heavy chain comprising SEQ ID NO: 592; a light chain comprising SEQ ID NO: 436 and a heavy chain comprising SEQ ID NO: 593; a light chain comprising SEQ ID NO: 437 and a heavy chain comprising SEQ ID NO: 594; a light chain comprising SEQ ID NO: 438 and a heavy chain comprising SEQ ID NO: 595; a light chain comprising SEQ ID NO: 439 and a heavy chain comprising SEQ ID NO: 596; a light chain comprising SEQ ID NO: 440 and a heavy chain comprising SEQ ID NO: 597; a light chain comprising SEQ ID NO: 441 and a heavy chain comprising SEQ ID NO: 598; a light chain comprising SEQ ID NO: 442 and a heavy chain comprising SEQ ID NO: 599; a light chain comprising SEQ ID NO: 443 and a heavy chain comprising SEQ ID NO: 600; a light chain comprising SEQ ID NO: 444 and a heavy chain comprising SEQ ID NO: 601; a light chain comprising SEQ ID NO: 445 and a heavy chain comprising SEQ ID NO: 602; a light chain comprising SEQ ID NO: 446 and a heavy chain comprising SEQ ID NO: 603; a light chain comprising SEQ ID NO: 447 and a heavy chain comprising SEQ ID NO: 604; a light chain comprising SEQ ID NO: 448 and a heavy chain comprising SEQ ID NO: 605; a light chain comprising SEQ ID NO: 449 and a heavy chain comprising SEQ ID NO: 606; a light chain comprising SEQ ID NO: 450 and a heavy chain comprising SEQ ID NO: 607; a light chain comprising SEQ ID NO: 451 and a heavy chain comprising SEQ ID NO: 608; a light chain comprising SEQ ID NO: 452 and a heavy chain comprising SEQ ID NO: 609; a light chain comprising SEQ ID NO: 453 and a heavy chain comprising SEQ ID NO: 610; a light chain comprising SEQ ID NO: 454 and a heavy chain comprising SEQ ID NO: 611; a light chain comprising SEQ ID NO: 455 and a heavy chain comprising SEQ ID NO: 612; a light chain comprising SEQ ID NO: 456 and a heavy chain comprising SEQ ID NO: 613; a light chain comprising SEQ ID NO: 457 and a heavy chain comprising SEQ ID NO: 614; a light chain comprising SEQ ID NO: 458 and a heavy chain comprising SEQ ID NO: 615; a light chain comprising SEQ ID NO: 459 and a heavy chain comprising SEQ ID NO: 616; a light chain comprising SEQ ID NO: 460 and a heavy chain comprising SEQ ID NO: 617; a light chain comprising SEQ ID NO: 461 and a heavy chain comprising SEQ ID NO: 618; a light chain comprising SEQ ID NO: 462 and a heavy chain comprising SEQ ID NO: 619; a light chain comprising SEQ ID NO: 463 and a heavy chain comprising SEQ ID NO: 620; a light chain comprising SEQ ID NO: 464 and a heavy chain comprising SEQ ID NO: 621; a light chain comprising SEQ ID NO: 465 and a heavy chain comprising SEQ ID NO: 622; a light chain comprising SEQ ID NO: 466 and a heavy chain comprising SEQ ID NO: 623; a light chain comprising SEQ ID NO: 467 and a heavy chain comprising SEQ ID NO: 624; a light chain comprising SEQ ID NO: 468 and a heavy chain comprising SEQ ID NO: 625; a light chain comprising SEQ ID NO: 469 and a heavy chain comprising SEQ ID NO: 626; a light chain comprising SEQ ID NO: 470 and a heavy chain comprising SEQ ID NO: 627; and a light chain comprising SEQ ID NO: 471 and a heavy chain comprising SEQ ID NO: 628.

In one embodiment the antibody or fragment thereof comprises a light chain encoded by a polynucleotide sequence selected from the group consisting of SEQ ID NOs: 1885-2014. In one embodiment the antibody or fragment thereof comprises a heavy chain encoded by a polynucleotide sequence selected from the group consisting of SEQ ID NOs: 2042-2198. In one embodiment the antibody or fragment thereof comprises a light chain encoded by a polynucleotide sequence selected from the group consisting of SEQ ID NOs: 1885-2014 and a heavy chain comprising a sequence selected from the group consisting of SEQ ID NOs: 2042-2198. In one embodiment the antibody or fragment thereof comprises a combination of light chain variable region and a heavy chain variable region selected from the group consisting of a light chain encoded by a polynucleotide sequence comprising SEQ ID NO: 1885 and a heavy chain encoded by a polynucleotide sequence comprising SEQ ID NO: 2042; a light chain encoded by a polynucleotide sequence comprising SEQ ID NO: 1886 and a heavy chain encoded by a polynucleotide sequence comprising SEQ ID NO: 2043; a light chain encoded by a polynucleotide sequence comprising SEQ ID NO: 1887 and a heavy chain encoded by a polynucleotide sequence comprising SEQ ID NO: 2044; a light chain encoded by a polynucleotide sequence comprising SEQ ID NO: 1888 and a heavy chain encoded by a polynucleotide sequence comprising SEQ ID NO: 2045; a light chain encoded by a polynucleotide sequence comprising SEQ ID NO: 1889 and a heavy chain encoded by a polynucleotide sequence comprising SEQ ID NO: 2046; a light chain encoded by a polynucleotide sequence comprising SEQ ID NO: 1890 and a heavy chain encoded by a polynucleotide sequence comprising SEQ ID NO: 2047; a light chain encoded by a polynucleotide sequence comprising SEQ ID NO: 1891 and a heavy chain encoded by a polynucleotide sequence comprising SEQ ID NO: 2048; a light chain encoded by a polynucleotide sequence comprising SEQ ID NO: 1892 and a heavy chain encoded by a polynucleotide sequence comprising SEQ ID NO: 2049; a light chain encoded by a polynucleotide sequence comprising SEQ ID NO: 1893 and a heavy chain encoded by a polynucleotide sequence comprising SEQ ID NO: 2050; a light chain encoded by a polynucleotide sequence comprising SEQ ID NO: 1894 and a heavy chain encoded by a polynucleotide sequence comprising SEQ ID NO: 2051; a light chain encoded by a polynucleotide sequence comprising SEQ ID NO: 1895 and a heavy chain encoded by a polynucleotide sequence comprising SEQ ID NO: 2052; a light chain encoded by a polynucleotide sequence comprising SEQ ID NO: 1896 and a heavy chain encoded by a polynucleotide sequence comprising SEQ ID NO: 2053; a light chain encoded by a polynucleotide sequence comprising SEQ ID NO: 1897 and a heavy chain encoded by a polynucleotide sequence comprising SEQ ID NO: 2054; a light chain encoded by a polynucleotide sequence comprising SEQ ID NO: 1898 and a heavy chain encoded by a polynucleotide sequence comprising SEQ ID NO: 2055; a light chain encoded by a polynucleotide sequence comprising SEQ ID NO: 1899 and a heavy chain encoded by a polynucleotide sequence comprising SEQ ID NO: 2056; a light chain encoded by a polynucleotide sequence comprising SEQ ID NO: 1900 and a heavy chain encoded by a polynucleotide sequence comprising SEQ ID NO: 2057; a light chain encoded by a polynucleotide sequence comprising SEQ ID NO: 1901 and a heavy chain encoded by a polynucleotide sequence comprising SEQ ID NO: 2058; a light chain encoded by a polynucleotide sequence comprising SEQ ID NO: 1902 and a heavy chain encoded by a polynucleotide sequence comprising SEQ ID NO: 2059; a light chain encoded by a polynucleotide sequence comprising SEQ ID NO: 1903 and a heavy chain encoded by a polynucleotide sequence comprising SEQ ID NO: 2060; a light chain encoded by a polynucleotide sequence comprising SEQ ID NO: 1904 and a heavy chain encoded by a polynucleotide sequence comprising SEQ ID NO: 2061; a light chain encoded by a polynucleotide sequence comprising SEQ ID NO: 1905 and a heavy chain encoded by a polynucleotide sequence comprising SEQ ID NO: 2062; a light chain encoded by a polynucleotide sequence comprising SEQ ID NO: 1906 and a heavy chain encoded by a polynucleotide sequence comprising SEQ ID NO: 2063; a light chain encoded by a polynucleotide sequence comprising SEQ ID NO: 1907 and a heavy chain encoded by a polynucleotide sequence comprising SEQ ID NO: 2064; a light chain encoded by a polynucleotide sequence comprising SEQ ID NO: 1908 and a heavy chain encoded by a polynucleotide sequence comprising SEQ ID NO: 2065; a light chain encoded by a polynucleotide sequence comprising SEQ ID NO: 1909 and a heavy chain encoded by a polynucleotide sequence comprising SEQ ID NO: 2066; a light chain encoded by a polynucleotide sequence comprising SEQ ID NO: 1910 and a heavy chain encoded by a polynucleotide sequence comprising SEQ ID NO: 2067; a light chain encoded by a polynucleotide sequence comprising SEQ ID NO: 1911 and a heavy chain encoded by a polynucleotide sequence comprising SEQ ID NO: 2068; a light chain encoded by a polynucleotide sequence comprising SEQ ID NO: 1912 and a heavy chain encoded by a polynucleotide sequence comprising SEQ ID NO: 2069; a light chain encoded by a polynucleotide sequence comprising SEQ ID NO: 1913 and a heavy chain encoded by a polynucleotide sequence comprising SEQ ID NO: 2070; a light chain encoded by a polynucleotide sequence comprising SEQ ID NO: 1914 and a heavy chain encoded by a polynucleotide sequence comprising SEQ ID NO: 2071; a light chain encoded by a polynucleotide sequence comprising SEQ ID NO: 1915 and a heavy chain encoded by a polynucleotide sequence comprising SEQ ID NO: 2072; a light chain encoded by a polynucleotide sequence comprising SEQ ID NO: 1916 and a heavy chain encoded by a polynucleotide sequence comprising SEQ ID NO: 2073; a light chain encoded by a polynucleotide sequence comprising SEQ ID NO: 1917 and a heavy chain encoded by a polynucleotide sequence comprising SEQ ID NO: 2074; a light chain encoded by a polynucleotide sequence comprising SEQ ID NO: 1918 and a heavy chain encoded by a polynucleotide sequence comprising SEQ ID NO: 2075; a light chain encoded by a polynucleotide sequence comprising SEQ ID NO: 1919 and a heavy chain encoded by a polynucleotide sequence comprising SEQ ID NO: 2076; a light chain encoded by a polynucleotide sequence comprising SEQ ID NO: 1920 and a heavy chain encoded by a polynucleotide sequence comprising SEQ ID NO: 2077; a light chain encoded by a polynucleotide sequence comprising SEQ ID NO: 1921 and a heavy chain encoded by a polynucleotide sequence comprising SEQ ID NO: 2078; a light chain encoded by a polynucleotide sequence comprising SEQ ID NO: 1922 and a heavy chain encoded by a polynucleotide sequence comprising SEQ ID NO: 2079; a light chain encoded by a polynucleotide sequence comprising SEQ ID NO: 1923 and a heavy chain encoded by a polynucleotide sequence comprising SEQ ID NO: 2080; a light chain encoded by a polynucleotide sequence comprising SEQ ID NO: 1924 and a heavy chain encoded by a polynucleotide sequence comprising SEQ ID NO: 2081; a light chain encoded by a polynucleotide sequence comprising SEQ ID NO: 1925 and a heavy chain encoded by a polynucleotide sequence comprising SEQ ID NO: 2082; a light chain encoded by a polynucleotide sequence comprising SEQ ID NO: 1926 and a heavy chain encoded by a polynucleotide sequence comprising SEQ ID NO: 2083; a light chain encoded by a polynucleotide sequence comprising SEQ ID NO: 1927 and a heavy chain encoded by a polynucleotide sequence comprising SEQ ID NO: 2084; a light chain encoded by a polynucleotide sequence comprising SEQ ID NO: 1928 and a heavy chain encoded by a polynucleotide sequence comprising SEQ ID NO: 2085; a light chain encoded by a polynucleotide sequence comprising SEQ ID NO: 1929 and a heavy chain encoded by a polynucleotide sequence comprising SEQ ID NO: 2086; a light chain encoded by a polynucleotide sequence comprising SEQ ID NO: 1930 and a heavy chain encoded by a polynucleotide sequence comprising SEQ ID NO: 2087; a light chain encoded by a polynucleotide sequence comprising SEQ ID NO: 1931 and a heavy chain encoded by a polynucleotide sequence comprising SEQ ID NO: 2088; a light chain encoded by a polynucleotide sequence comprising SEQ ID NO: 1932 and a heavy chain encoded by a polynucleotide sequence comprising SEQ ID NO: 2089; a light chain encoded by a polynucleotide sequence comprising SEQ ID NO: 1933 and a heavy chain encoded by a polynucleotide sequence comprising SEQ ID NO: 2090; a light chain encoded by a polynucleotide sequence comprising SEQ ID NO: 1934 and a heavy chain encoded by a polynucleotide sequence comprising SEQ ID NO: 2091; a light chain encoded by a polynucleotide sequence comprising SEQ ID NO: 1935 and a heavy chain encoded by a polynucleotide sequence comprising SEQ ID NO: 2092; a light chain encoded by a polynucleotide sequence comprising SEQ ID NO: 1936 and a heavy chain encoded by a polynucleotide sequence comprising SEQ ID NO: 2093; a light chain encoded by a polynucleotide sequence comprising SEQ ID NO: 1937 and a heavy chain encoded by a polynucleotide sequence comprising SEQ ID NO: 2094; a light chain encoded by a polynucleotide sequence comprising SEQ ID NO: 1938 and a heavy chain encoded by a polynucleotide sequence comprising SEQ ID NO: 2095; a light chain encoded by a polynucleotide sequence comprising SEQ ID NO: 1939 and a heavy chain encoded by a polynucleotide sequence comprising SEQ ID NO: 2096; a light chain encoded by a polynucleotide sequence comprising SEQ ID NO: 1940 and a heavy chain encoded by a polynucleotide sequence comprising SEQ ID NO: 2097; a light chain encoded by a polynucleotide sequence comprising SEQ ID NO: 1941 and a heavy chain encoded by a polynucleotide sequence comprising SEQ ID NO: 2098; a light chain encoded by a polynucleotide sequence comprising SEQ ID NO: 1942 and a heavy chain encoded by a polynucleotide sequence comprising SEQ ID NO: 2099; a light chain encoded by a polynucleotide sequence comprising SEQ ID NO: 1943 and a heavy chain encoded by a polynucleotide sequence comprising SEQ ID NO: 2100; a light chain encoded by a polynucleotide sequence comprising SEQ ID NO: 1944 and a heavy chain encoded by a polynucleotide sequence comprising SEQ ID NO: 2101; a light chain encoded by a polynucleotide sequence comprising SEQ ID NO: 1945 and a heavy chain encoded by a polynucleotide sequence comprising SEQ ID NO: 2102; a light chain encoded by a polynucleotide sequence comprising SEQ ID NO: 1946 and a heavy chain encoded by a polynucleotide sequence comprising SEQ ID NO: 2103; a light chain encoded by a polynucleotide sequence comprising SEQ ID NO: 1947 and a heavy chain encoded by a polynucleotide sequence comprising SEQ ID NO: 2104; a light chain encoded by a polynucleotide sequence comprising SEQ ID NO: 1948 and a heavy chain encoded by a polynucleotide sequence comprising SEQ ID NO: 2105; a light chain encoded by a polynucleotide sequence comprising SEQ ID NO: 1949 and a heavy chain encoded by a polynucleotide sequence comprising SEQ ID NO: 2106; a light chain encoded by a polynucleotide sequence comprising SEQ ID NO: 1950 and a heavy chain encoded by a polynucleotide sequence comprising SEQ ID NO: 2107; a light chain encoded by a polynucleotide sequence comprising SEQ ID NO: 1951 and a heavy chain encoded by a polynucleotide sequence comprising SEQ ID NO: 2108; a light chain encoded by a polynucleotide sequence comprising SEQ ID NO: 1952 and a heavy chain encoded by a polynucleotide sequence comprising SEQ ID NO: 2109; a light chain encoded by a polynucleotide sequence comprising SEQ ID NO: 1953 and a heavy chain encoded by a polynucleotide sequence comprising SEQ ID NO: 2110; a light chain encoded by a polynucleotide sequence comprising SEQ ID NO: 1954 and a heavy chain encoded by a polynucleotide sequence comprising SEQ ID NO: 2111; a light chain encoded by a polynucleotide sequence comprising SEQ ID NO: 1955 and a heavy chain encoded by a polynucleotide sequence comprising SEQ ID NO: 2112; a light chain encoded by a polynucleotide sequence comprising SEQ ID NO: 1956 and a heavy chain encoded by a polynucleotide sequence comprising SEQ ID NO: 2113; a light chain encoded by a polynucleotide sequence comprising SEQ ID NO: 1957 and a heavy chain encoded by a polynucleotide sequence comprising SEQ ID NO: 2114; a light chain encoded by a polynucleotide sequence comprising SEQ ID NO: 1958 and a heavy chain encoded by a polynucleotide sequence comprising SEQ ID NO: 2115; a light chain encoded by a polynucleotide sequence comprising SEQ ID NO: 1959 and a heavy chain encoded by a polynucleotide sequence comprising SEQ ID NO: 2116; a light chain encoded by a polynucleotide sequence comprising SEQ ID NO: 1960 and a heavy chain encoded by a polynucleotide sequence comprising SEQ ID NO: 2117; a light chain encoded by a polynucleotide sequence comprising SEQ ID NO: 1961 and a heavy chain encoded by a polynucleotide sequence comprising SEQ ID NO: 2118; a light chain encoded by a polynucleotide sequence comprising SEQ ID NO: 1962 and a heavy chain encoded by a polynucleotide sequence comprising SEQ ID NO: 2119; a light chain encoded by a polynucleotide sequence comprising SEQ ID NO: 1963 and a heavy chain encoded by a polynucleotide sequence comprising SEQ ID NO: 2120; a light chain encoded by a polynucleotide sequence comprising SEQ ID NO: 1964 and a heavy chain encoded by a polynucleotide sequence comprising SEQ ID NO: 2121; a light chain encoded by a polynucleotide sequence comprising SEQ ID NO: 1965 and a heavy chain encoded by a polynucleotide sequence comprising SEQ ID NO: 2122; a light chain encoded by a polynucleotide sequence comprising SEQ ID NO: 1966 and a heavy chain encoded by a polynucleotide sequence comprising SEQ ID NO: 2123; a light chain encoded by a polynucleotide sequence comprising SEQ ID NO: 1967 and a heavy chain encoded by a polynucleotide sequence comprising SEQ ID NO: 2124; a light chain encoded by a polynucleotide sequence comprising SEQ ID NO: 1968 and a heavy chain encoded by a polynucleotide sequence comprising SEQ ID NO: 2125; a light chain encoded by a polynucleotide sequence comprising SEQ ID NO: 1969 and a heavy chain encoded by a polynucleotide sequence comprising SEQ ID NO: 2126; a light chain encoded by a polynucleotide sequence comprising SEQ ID NO: 1970 and a heavy chain encoded by a polynucleotide sequence comprising SEQ ID NO: 2127; a light chain encoded by a polynucleotide sequence comprising SEQ ID NO: 1971 and a heavy chain encoded by a polynucleotide sequence comprising SEQ ID NO: 2128; a light chain encoded by a polynucleotide sequence comprising SEQ ID NO: 1972 and a heavy chain encoded by a polynucleotide sequence comprising SEQ ID NO: 2129; a light chain encoded by a polynucleotide sequence comprising SEQ ID NO: 1973 and a heavy chain encoded by a polynucleotide sequence comprising SEQ ID NO: 2130; a light chain encoded by a polynucleotide sequence comprising SEQ ID NO: 1974 and a heavy chain encoded by a polynucleotide sequence comprising SEQ ID NO: 2131; a light chain encoded by a polynucleotide sequence comprising SEQ ID NO: 1975 and a heavy chain encoded by a polynucleotide sequence comprising SEQ ID NO: 2132; a light chain encoded by a polynucleotide sequence comprising SEQ ID NO: 1976 and a heavy chain encoded by a polynucleotide sequence comprising SEQ ID NO: 2133; a light chain encoded by a polynucleotide sequence comprising SEQ ID NO: 1977 and a heavy chain encoded by a polynucleotide sequence comprising SEQ ID NO: 2134; a light chain encoded by a polynucleotide sequence comprising SEQ ID NO: 1978 and a heavy chain encoded by a polynucleotide sequence comprising SEQ ID NO: 2135; a light chain encoded by a polynucleotide sequence comprising SEQ ID NO: 1979 and a heavy chain encoded by a polynucleotide sequence comprising SEQ ID NO: 2136; a light chain encoded by a polynucleotide sequence comprising SEQ ID NO: 1980 and a heavy chain encoded by a polynucleotide sequence comprising SEQ ID NO: 2137; a light chain encoded by a polynucleotide sequence comprising SEQ ID NO: 1981 and a heavy chain encoded by a polynucleotide sequence comprising SEQ ID NO: 2138; a light chain encoded by a polynucleotide sequence comprising SEQ ID NO: 1982 and a heavy chain encoded by a polynucleotide sequence comprising SEQ ID NO: 2139; a light chain encoded by a polynucleotide sequence comprising SEQ ID NO: 1983 and a heavy chain encoded by a polynucleotide sequence comprising SEQ ID NO: 2140; a light chain encoded by a polynucleotide sequence comprising SEQ ID NO: 1984 and a heavy chain encoded by a polynucleotide sequence comprising SEQ ID NO: 2141; a light chain encoded by a polynucleotide sequence comprising SEQ ID NO: 1985 and a heavy chain encoded by a polynucleotide sequence comprising SEQ ID NO: 2142; a light chain encoded by a polynucleotide sequence comprising SEQ ID NO: 1986 and a heavy chain encoded by a polynucleotide sequence comprising SEQ ID NO: 2143; a light chain encoded by a polynucleotide sequence comprising SEQ ID NO: 1987 and a heavy chain encoded by a polynucleotide sequence comprising SEQ ID NO: 2144; a light chain encoded by a polynucleotide sequence comprising SEQ ID NO: 1988 and a heavy chain encoded by a polynucleotide sequence comprising SEQ ID NO: 2145; a light chain encoded by a polynucleotide sequence comprising SEQ ID NO: 1989 and a heavy chain encoded by a polynucleotide sequence comprising SEQ ID NO: 2146; a light chain encoded by a polynucleotide sequence comprising SEQ ID NO: 1990 and a heavy chain encoded by a polynucleotide sequence comprising SEQ ID NO: 2147; a light chain encoded by a polynucleotide sequence comprising SEQ ID NO: 1991 and a heavy chain encoded by a polynucleotide sequence comprising SEQ ID NO: 2148; a light chain encoded by a polynucleotide sequence comprising SEQ ID NO: 1992 and a heavy chain encoded by a polynucleotide sequence comprising SEQ ID NO: 2149; a light chain encoded by a polynucleotide sequence comprising SEQ ID NO: 1993 and a heavy chain encoded by a polynucleotide sequence comprising SEQ ID NO: 2150; a light chain encoded by a polynucleotide sequence comprising SEQ ID NO: 1994 and a heavy chain encoded by a polynucleotide sequence comprising SEQ ID NO: 2151; a light chain encoded by a polynucleotide sequence comprising SEQ ID NO: 1995 and a heavy chain encoded by a polynucleotide sequence comprising SEQ ID NO: 2152; a light chain encoded by a polynucleotide sequence comprising SEQ ID NO: 1996 and a heavy chain encoded by a polynucleotide sequence comprising SEQ ID NO: 2153; a light chain encoded by a polynucleotide sequence comprising SEQ ID NO: 1997 and a heavy chain encoded by a polynucleotide sequence comprising SEQ ID NO: 2154; a light chain encoded by a polynucleotide sequence comprising SEQ ID NO: 1998 and a heavy chain encoded by a polynucleotide sequence comprising SEQ ID NO: 2155; a light chain encoded by a polynucleotide sequence comprising SEQ ID NO: 1999 and a heavy chain encoded by a polynucleotide sequence comprising SEQ ID NO: 2156; a light chain encoded by a polynucleotide sequence comprising SEQ ID NO: 2000 and a heavy chain encoded by a polynucleotide sequence comprising SEQ ID NO: 2157; a light chain encoded by a polynucleotide sequence comprising SEQ ID NO: 2001 and a heavy chain encoded by a polynucleotide sequence comprising SEQ ID NO: 2158; a light chain encoded by a polynucleotide sequence comprising SEQ ID NO: 2002 and a heavy chain encoded by a polynucleotide sequence comprising SEQ ID NO: 2159; a light chain encoded by a polynucleotide sequence comprising SEQ ID NO: 2003 and a heavy chain encoded by a polynucleotide sequence comprising SEQ ID NO: 2160; a light chain encoded by a polynucleotide sequence comprising SEQ ID NO: 2004 and a heavy chain encoded by a polynucleotide sequence comprising SEQ ID NO: 2161; a light chain encoded by a polynucleotide sequence comprising SEQ ID NO: 2005 and a heavy chain encoded by a polynucleotide sequence comprising SEQ ID NO: 2162; a light chain encoded by a polynucleotide sequence comprising SEQ ID NO: 2006 and a heavy chain encoded by a polynucleotide sequence comprising SEQ ID NO: 2163; a light chain encoded by a polynucleotide sequence comprising SEQ ID NO: 2007 and a heavy chain encoded by a polynucleotide sequence comprising SEQ ID NO: 2164; a light chain encoded by a polynucleotide sequence comprising SEQ ID NO: 2008 and a heavy chain encoded by a polynucleotide sequence comprising SEQ ID NO: 2165; a light chain encoded by a polynucleotide sequence comprising SEQ ID NO: 2009 and a heavy chain encoded by a polynucleotide sequence comprising SEQ ID NO: 2166; a light chain encoded by a polynucleotide sequence comprising SEQ ID NO: 2010 and a heavy chain encoded by a polynucleotide sequence comprising SEQ ID NO: 2167; a light chain encoded by a polynucleotide sequence comprising SEQ ID NO: 2011 and a heavy chain encoded by a polynucleotide sequence comprising SEQ ID NO: 2168; a light chain encoded by a polynucleotide sequence comprising SEQ ID NO: 2012 and a heavy chain encoded by a polynucleotide sequence comprising SEQ ID NO: 2169; a light chain encoded by a polynucleotide sequence comprising SEQ ID NO: 2013 and a heavy chain encoded by a polynucleotide sequence comprising SEQ ID NO: 2170; a light chain encoded by a polynucleotide sequence comprising SEQ ID NO: 2014 and a heavy chain encoded by a polynucleotide sequence comprising SEQ ID NO: 2171; a light chain encoded by a polynucleotide sequence comprising SEQ ID NO: 2015 and a heavy chain encoded by a polynucleotide sequence comprising SEQ ID NO: 2172; a light chain encoded by a polynucleotide sequence comprising SEQ ID NO: 2016 and a heavy chain encoded by a polynucleotide sequence comprising SEQ ID NO: 2173; a light chain encoded by a polynucleotide sequence comprising SEQ ID NO: 2017 and a heavy chain encoded by a polynucleotide sequence comprising SEQ ID NO: 2174; a light chain encoded by a polynucleotide sequence comprising SEQ ID NO: 2018 and a heavy chain encoded by a polynucleotide sequence comprising SEQ ID NO: 2175; a light chain encoded by a polynucleotide sequence comprising SEQ ID NO: 2019 and a heavy chain encoded by a polynucleotide sequence comprising SEQ ID NO: 2176; a light chain encoded by a polynucleotide sequence comprising SEQ ID NO: 2020 and a heavy chain encoded by a polynucleotide sequence comprising SEQ ID NO: 2177; a light chain encoded by a polynucleotide sequence comprising SEQ ID NO: 2021 and a heavy chain encoded by a polynucleotide sequence comprising SEQ ID NO: 2178; a light chain encoded by a polynucleotide sequence comprising SEQ ID NO: 2022 and a heavy chain encoded by a polynucleotide sequence comprising SEQ ID NO: 2179; a light chain encoded by a polynucleotide sequence comprising SEQ ID NO: 2023 and a heavy chain encoded by a polynucleotide sequence comprising SEQ ID NO: 2180; a light chain encoded by a polynucleotide sequence comprising SEQ ID NO: 2024 and a heavy chain encoded by a polynucleotide sequence comprising SEQ ID NO: 2181; a light chain encoded by a polynucleotide sequence comprising SEQ ID NO: 2025 and a heavy chain encoded by a polynucleotide sequence comprising SEQ ID NO: 2182; a light chain encoded by a polynucleotide sequence comprising SEQ ID NO: 2026 and a heavy chain encoded by a polynucleotide sequence comprising SEQ ID NO: 2183; a light chain encoded by a polynucleotide sequence comprising SEQ ID NO: 2027 and a heavy chain encoded by a polynucleotide sequence comprising SEQ ID NO: 2184; a light chain encoded by a polynucleotide sequence comprising SEQ ID NO: 2028 and a heavy chain encoded by a polynucleotide sequence comprising SEQ ID NO: 2185; a light chain encoded by a polynucleotide sequence comprising SEQ ID NO: 2029 and a heavy chain encoded by a polynucleotide sequence comprising SEQ ID NO: 2186; a light chain encoded by a polynucleotide sequence comprising SEQ ID NO: 2030 and a heavy chain encoded by a polynucleotide sequence comprising SEQ ID NO: 2187; a light chain encoded by a polynucleotide sequence comprising SEQ ID NO: 2031 and a heavy chain encoded by a polynucleotide sequence comprising SEQ ID NO: 2188; a light chain encoded by a polynucleotide sequence comprising SEQ ID NO: 2032 and a heavy chain encoded by a polynucleotide sequence comprising SEQ ID NO: 2189; a light chain encoded by a polynucleotide sequence comprising SEQ ID NO: 2033 and a heavy chain encoded by a polynucleotide sequence comprising SEQ ID NO: 2190; a light chain encoded by a polynucleotide sequence comprising SEQ ID NO: 2034 and a heavy chain encoded by a polynucleotide sequence comprising SEQ ID NO: 2191; a light chain encoded by a polynucleotide sequence comprising SEQ ID NO: 2035 and a heavy chain encoded by a polynucleotide sequence comprising SEQ ID NO: 2192; a light chain encoded by a polynucleotide sequence comprising SEQ ID NO: 2036 and a heavy chain encoded by a polynucleotide sequence comprising SEQ ID NO: 2193; a light chain encoded by a polynucleotide sequence comprising SEQ ID NO: 2037 and a heavy chain encoded by a polynucleotide sequence comprising SEQ ID NO: 2194; a light chain encoded by a polynucleotide sequence comprising SEQ ID NO: 2038 and a heavy chain encoded by a polynucleotide sequence comprising SEQ ID NO: 2195; a light chain encoded by a polynucleotide sequence comprising SEQ ID NO: 2039 and a heavy chain encoded by a polynucleotide sequence comprising SEQ ID NO: 2196; a light chain encoded by a polynucleotide sequence comprising SEQ ID NO: 2040 and a heavy chain encoded by a polynucleotide sequence comprising SEQ ID NO: 2197; and a light chain encoded by a polynucleotide sequence comprising SEQ ID NO: 2041 and a heavy chain encoded by a polynucleotide sequence comprising SEQ ID NO: 2198.

In some aspects, the invention comprises an antibody or fragment thereof that binds to GIPR, wherein the antibody or fragment thereof binds to GIPR within a location corresponding to residues 123-134 of SEQ ID NO: 3141. In one embodiment, the antibody or fragment thereof binds to GIPR within the discontinuous epitope of residues 29-30 and 123-134 of SEQ ID NO: 3141. In some embodiments, when the antibody or fragment thereof is bound to GIPR, the antibody or fragment thereof when bound to GIPR is positioned 8 angstroms or less from at least one residue of GIPR (SEQ ID NO: 3141) selected from the group consisting of G29, Q30, T31, A32, G33, E34, L35, Y36, Q37, R38, W39, E40, R43, F65, D66, M67, Y68, V69, W71, P85, Y87, L88, P89, W90, R101, L111, W112, R113, H115, T116, C118, E119, N120, E122, K123, N124, E125, A126, L128, D129, Q130, R131, L132, I133, and L134. In some embodiments, when the antibody or fragment thereof is bound to GIPR, the antibody or fragment thereof when bound to GIPR is positioned 8 angstroms or less from at least one residue of GIPR (SEQ ID NO: 3141) selected from the group consisting of G29, Q30, K123, N124, E125, A126, L128, D129, Q130, R131, L132, I133, and L134. In some embodiments, when the antibody or fragment thereof is bound to GIPR, the antibody or fragment thereof when bound to GIPR is positioned 8 angstroms or less from at least one residue of GIPR (SEQ ID NO: 3141) selected from the group consisting of K123, N124, E125, A126, L128, D129, Q130, R131, L132, I133, and L134. In some embodiments, when the antibody or fragment thereof is bound to GIPR, the antibody or fragment thereof when bound to GIPR is positioned 8 angstroms or less from at least 2, 3, 4, 5, 6, 7, 8, 9, 10, 11, 12, or 13 residues of GIPR (SEQ ID NO: 3141) selected from the group consisting of G29, Q30, K123, N124, E125, A126, L128, D129, Q130, R131, L132, I133, and L134. In some embodiments, when the antibody or fragment thereof is bound to GIPR, the antibody or fragment thereof when bound to GIPR is positioned 8 angstroms or less from at least 2, 3, 4, 5, 6, 7, 8, 9, 10, or 11 residues of GIPR (SEQ ID NO: 3141) selected from the group consisting of K123, N124, E125, A126, L128, D129, Q130, R131, L132, I133, and L134.

In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of Q30, T31, A32, G33, E34, L35, Y36, Q37, W39, D66, M67, Y68, Y87, L88, P89, W90, R101, R113, H115, E119, K123, E125, L128, D129, L132, and I133. In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of Q30, T31, K123, E125, L128, D129, L132, and I133. In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of K123, E125, L128, D129, L132, and I133. In some embodiments, when the antibody or fragment thereof is bound to GIPR, the antibody or fragment thereof when bound to GIPR is positioned 5 angstroms or less from at least 2, 3, 4, 5, 6, 7, or 8 residues of GIPR (SEQ ID NO: 3141) selected from the group consisting of Q30, T31, K123, E125, L128, D129, L132, and I133. In some embodiments, when the antibody or fragment thereof is bound to GIPR, the antibody or fragment thereof when bound to GIPR is positioned 5 angstroms or less from at least 2, 3, 4, 5, or 6 residues of GIPR (SEQ ID NO: 3141) selected from the group consisting of K123, E125, L128, D129, L132, and I133.

In some aspects, the invention comprises an antibody or fragment thereof that binds to GIPR, wherein the antibody or fragment thereof binds to GIPR within a location corresponding to residues 102-107 of SEQ ID NO: 3141. In one embodiment, the antibody or fragment thereof binds to GIPR within the discontinuous epitope of residues 60-63 and 102-107 of SEQ ID NO: 3141. In some embodiments, when the antibody or fragment thereof is bound to GIPR, the antibody or fragment thereof when bound to GIPR is positioned 8 angstroms or less from at least one residue of GIPR (SEQ ID NO: 3141) selected from the group consisting of Q30, T31, A32, G33, E34, L35, Y36, W39, E40, R43, Q47, A60, C61, N62, G63, S64, F65, D66, M67, Y68, V69, W71, N77, P85, Y87, L88, P89, W90, V99, L100, R101, Q102, C103, G104, S105, D106, G107, Q108, W109, G110, L111, W112, R113, D114, H115, T116, Q117, C118, E119, N120, and P121. In some embodiments, when the antibody or fragment thereof is bound to GIPR, the antibody or fragment thereof when bound to GIPR is positioned 8 angstroms or less from at least one residue of GIPR (SEQ ID NO: 3141) selected from the group consisting of Q30, A60, C61, N62, G63, N77, L100, Q102, C103, G104, S105, D106, G107, W109, and G110. In some embodiments, when the antibody or fragment thereof is bound to GIPR, the antibody or fragment thereof when bound to GIPR is positioned 8 angstroms or less from at least 2, 3, 4, 5, 6, 7, 8, 9, 10, 11, 12, 13, 14, or 15 residues of GIPR (SEQ ID NO: 3141) selected from the group consisting of Q30, A60, C61, N62, G63, N77, L100, Q102, C103, G104, S105, D106, G107, W109, and G110. In some embodiments, when the antibody or fragment thereof is bound to GIPR, the antibody or fragment thereof when bound to GIPR is positioned 8 angstroms or less from at least 2, 3, 4, 5, 6, 7, 8, 9, or 10 residues of GIPR (SEQ ID NO: 3141) selected from the group consisting of A60, C61, N62, G63, Q102, C103, G104, S105, D106, and G107.

In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of T31, A32, L35, Y36, W39, N62, S64, F65, D66, M67, Y68, W71, Y87, L88, P89, W90, R101, G104, S105, D106, Q108, W109, G110, L111, W112, R113, D114, H115, T116, and E119. In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of T31, N62, S64, W71, R101, G104, S105, D106, Q108, W109, G110, L111, W112, D114, and T116. In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of R101, G104, S105, D106, Q108, W109, G110, L111, W112, D114, and T116. In some embodiments, when the antibody or fragment thereof is bound to GIPR, the antibody or fragment thereof when bound to GIPR is positioned 5 angstroms or less from at least 2, 3, 4, 5, 6, 7, 8, 9, 10, 11, 12, 13, 14, or 15 residues of GIPR (SEQ ID NO: 3141) selected from the group consisting of T31, N62, S64, W71, R101, G104, S105, D106, Q108, W109, G110, L111, W112, D114, and T116. In some embodiments, when the antibody or fragment thereof is bound to GIPR, the antibody or fragment thereof when bound to GIPR is positioned 5 angstroms or less from at least 2, 3, 4, 5, 6, 7, 8, 9, 10, or 11 residues of GIPR (SEQ ID NO: 3141) selected from the group consisting of R101, G104, S105, D106, Q108, W109, G110, L111, W112, D114, and T116.

In some embodiments, when the antibody or fragment thereof is bound to GIPR, the antibody or fragment thereof when bound to GIPR is positioned 8 angstroms or less from at least one residue of GIPR (SEQ ID NO: 3141) selected from the group consisting of A32, G33, E34, L35, Y36, Q37, R38, W39, E40, R43, F65, D66, M67, Y68, P85, Y87, L88, P89, W90, L111, W112, R113, D114, H115, C118, E119, N120, and P121. In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of A32, G33, E34, L35, Y36, Q37, W39, E40, R43, D66, M67, Y87, L88, P89, W90, L111, W112, H115, E119, and N120. In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of E34, L111, W112, and N120.

In some aspects, the invention comprises an antibody or fragment thereof that binds to GIPR, wherein the antibody or fragment thereof binds to GIPR within a location corresponding to residues 102-107 of SEQ ID NO: 3141. In one embodiment, the antibody or fragment thereof binds to GIPR within the discontinuous epitope of residues 60-63 and 102-107 of SEQ ID NO: 3141. In some embodiments, when the antibody or fragment thereof is bound to GIPR, the antibody or fragment thereof when bound to GIPR is positioned 8 angstroms or less from at least one residue of GIPR (SEQ ID NO: 3141) selected from the group consisting of Q30, T31, A32, G33, E34, L35, Y36, Q37, R38, W39, E40, R43, F65, D66, M67, Y68, V69, W71, P85, Y87, L88, P89, W90, V99, R101, L111, R113, D114, H115, T116, C118, E119, and N120. In some embodiments, when the antibody or fragment thereof is bound to GIPR, the antibody or fragment thereof when bound to GIPR is positioned 8 angstroms or less from Q30 of GIPR (SEQ ID NO: 3141).

In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of Q30, T31, A32, G33, L35, Y36, Q37, W39, E40, R43, D66, M67, Y68, Y87, L88, P89, W90, R113, H115, and E119. In some embodiments, when the antibody or fragment thereof is bound to GIPR, the antibody or fragment thereof when bound to GIPR is positioned 5 angstroms or less from at least one residue of GIPR (SEQ ID NO: 3141) selected from the group consisting of Q30 and T31. In some embodiments, when the antibody or fragment thereof is bound to GIPR, the antibody or fragment thereof when bound to GIPR is positioned 5 angstroms or less from both Q30 and T31 of GIPR (SEQ ID NO: 3141).

In some aspects, the invention comprises an antibody that binds to GIPR, wherein the antibody binds to GIPR and reduces the likelihood that GIPR binds to GIP.

In some aspects, the invention comprises an antibody or fragment thereof that binds to GIPR, wherein the antibody or fragment thereof binds to GIPR within a location corresponding to residues 28-108 of SEQ ID NO: 231 of the heavy chain of the antibody or fragment thereof. In some embodiments, when the antibody or fragment thereof is bound to GIPR, GIPR is positioned 8 angstroms or less from at least one residue of the heavy chain of the antibody or fragment thereof selected from the group consisting of T28, F29, S30, N31, Y32, G33, A50, I51, W52, F53, D54, A55, S56, D57, K58, Y59, Y60, A61, D62, V64, K65, G66, R67, F68, T69, I70, S71, R72, D73, N74, S75, Q82, N84, S85, R98, D99, Q100, A101, I102, F103, G104, V105, V106, and D108 corresponding to the heavy chain of SEQ ID NO: 231. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, or 44 residues of the heavy chain of the antibody or fragment thereof selected from the group consisting of T28, F29, S30, N31, Y32, G33, A50, I51, W52, F53, D54, A55, S56, D57, K58, Y59, Y60, A61, D62, V64, K65, G66, R67, F68, T69, I70, S71, R72, D73, N74, S75, Q82, N84, S85, R98, D99, Q100, A101, I102, F103, G104, V105, V106, and D108 corresponding to the heavy chain of SEQ ID NO: 231.

In some embodiments, when the antibody or fragment thereof is bound to GIPR, GIPR is positioned 5 angstroms or less from at least one residue of the heavy chain of the antibody or fragment thereof selected from the group consisting of S30, N31, Y32, W52, F53, D54, A55, S56, D57, K58, Y59, Y60, K65, G66, R67, T69, I70, S71, N84, Q100, A101, I102, F103, and V105 corresponding to the heavy chain of SEQ ID NO: 231. In some embodiments, when the antibody or fragment thereof is bound to GIPR, GIPR is positioned 5 angstroms or less from at least 2, 3, 4, 5, 6, 7, 8, 9, 10, 11, 12, 13, 14, 15, 16, 17, 18, 19, 20, 21, 22, 23, or 24 residues of the heavy chain of the antibody or fragment thereof selected from the group consisting of S30, N31, Y32, W52, F53, D54, A55, S56, D57, K58, Y59, Y60, K65, G66, R67, T69, I70, S71, N84, Q100, A101, I102, F103, and V105 corresponding to the heavy chain of SEQ ID NO: 231.

In some aspects, the invention comprises an antibody or fragment thereof that binds to GIPR, wherein the antibody or fragment thereof binds to GIPR within a location corresponding to residues 29-96 of SEQ ID NO: 74 of the light chain of the antibody or fragment thereof. In some embodiments, when the antibody or fragment thereof is bound to GIPR, GIPR is positioned 8 angstroms or less from at least one residue of the light chain of the antibody or fragment thereof selected from the group consisting of V29, S30, S31, N32, L33, L46, Y49, G50, T53, Q90, Y91, N92, N93, W94, P95, and L96 corresponding to the light chain of SEQ ID NO: 74. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, or 16 residues of the light chain of the antibody or fragment thereof selected from the group consisting of V29, S30, S31, N32, L33, L46, Y49, G50, T53, Q90, Y91, N92, N93, W94, P95, and L96 corresponding to the light chain of SEQ ID NO: 74.

In some embodiments, when the antibody or fragment thereof is bound to GIPR, GIPR is positioned 5 angstroms or less from at least one residue of the light chain of the antibody or fragment thereof selected from the group consisting of S30, N32, Y49, Y91, N92, N93, W94, and L96 corresponding to the light chain of SEQ ID NO: 74. In some embodiments, when the antibody or fragment thereof is bound to GIPR, GIPR is positioned 5 angstroms or less from at least 2, 3, 4, 5, 6, 7, or 8 residues of the light chain of the antibody or fragment thereof selected from the group consisting of S30, N32, Y49, Y91, N92, N93, W94, and L96 corresponding to the light chain of SEQ ID NO: 74.

In some aspects, the invention comprises an antibody or fragment thereof that binds to GIPR, wherein the antibody or fragment thereof binds to GIPR within a location corresponding to residues 28-108 of SEQ ID NO: 231 of the heavy chain of the antibody or fragment thereof and within a location corresponding to residues 29-96 of SEQ ID NO: 74 of the light chain of the antibody or fragment thereof. In some embodiments, when the antibody or fragment thereof is bound to GIPR, GIPR is positioned 8 angstroms or less from at least one residue of the heavy chain of the antibody or fragment thereof selected from the group consisting of T28, F29, S30, N31, Y32, G33, A50, I51, W52, F53, D54, A55, S56, D57, K58, Y59, Y60, A61, D62, V64, K65, G66, R67, F68, T69, I70, S71, R72, D73, N74, S75, Q82, N84, S85, R98, D99, Q100, A101, I102, F103, G104, V105, V106, and D108 corresponding to the heavy chain of SEQ ID NO: 231; and 8 angstroms or less from at least one residue of the light chain of the antibody or fragment thereof selected from the group consisting of V29, S30, S31, N32, L33, L46, Y49, G50, T53, Q90, Y91, N92, N93, W94, P95, and L96 corresponding to the light chain of SEQ ID NO: 74. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, or 44 residues of the heavy chain of the antibody or fragment thereof selected from the group consisting of T28, F29, S30, N31, Y32, G33, A50, I51, W52, F53, D54, A55, S56, D57, K58, Y59, Y60, A61, D62, V64, K65, G66, R67, F68, T69, I70, S71, R72, D73, N74, S75, Q82, N84, S85, R98, D99, Q100, A101, I102, F103, G104, V105, V106, and D108 corresponding to the heavy chain of SEQ ID NO: 231; and 8 angstroms or less from at least 2, 3, 4, 5, 6, 7, 8, 9, 10, 11, 12, 13, 14, 15, or 16 residues of the light chain of the antibody or fragment thereof selected from the group consisting of V29, S30, S31, N32, L33, L46, Y49, G50, T53, Q90, Y91, N92, N93, W94, P95, and L96 corresponding to the light chain of SEQ ID NO: 74.

In some embodiments, when the antibody or fragment thereof is bound to GIPR, GIPR is positioned 5 angstroms or less from at least one residue of the heavy chain of the antibody or fragment thereof selected from the group consisting of S30, N31, Y32, W52, F53, D54, A55, S56, D57, K58, Y59, Y60, K65, G66, R67, T69, I70, S71, N84, Q100, A101, I102, F103, and V105 corresponding to the heavy chain of SEQ ID NO: 231; and 5 angstroms or less from at least one residue of the light chain of the antibody or fragment thereof selected from the group consisting of S30, N32, Y49, Y91, N92, N93, W94, and L96 corresponding to the light chain of SEQ ID NO: 74. In some embodiments, when the antibody or fragment thereof is bound to GIPR, GIPR is positioned 5 angstroms or less from at least 2, 3, 4, 5, 6, 7, 8, 9, 10, 11, 12, 13, 14, 15, 16, 17, 18, 19, 20, 21, 22, 23, or 24 residues of the heavy chain of the antibody or fragment thereof selected from the group consisting of S30, N31, Y32, W52, F53, D54, A55, S56, D57, K58, Y59, Y60, K65, G66, R67, T69, I70, S71, N84, Q100, A101, I102, F103, and V105 corresponding to the heavy chain of SEQ ID NO: 231; and 5 angstroms or less from at least 2, 3, 4, 5, 6, 7, or 8 residues of the light chain of the antibody or fragment thereof selected from the group consisting of S30, N32, Y49, Y91, N92, N93, W94, and L96 corresponding to the light chain of SEQ ID NO: 74.

In some aspects, the invention comprises an antibody or fragment thereof that binds to GIPR, wherein the antibody or fragment thereof binds to GIPR within a location corresponding to residues 1-118 of SEQ ID NO: 294 of the heavy chain of the antibody or fragment thereof. In some embodiments, when the antibody or fragment thereof is bound to GIPR, GIPR is positioned 8 angstroms or less from at least one residue of the heavy chain of the antibody or fragment thereof selected from the group consisting of Q1, M2, S25, G26, Y27, T28, F29, T30, G31, Y32, N54, R98, G99, G100, D101, Y102, V103, F104, G105, T106, Y107, R108, P109, H110, Y111, Y112, Y113, G114, M115, D116, V117, and W118 corresponding to the heavy chain of SEQ ID NO: 294. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, or 32 residues of the heavy chain of the antibody or fragment thereof selected from the group consisting of Q1, M2, S25, G26, Y27, T28, F29, T30, G31, Y32, N54, R98, G99, G100, D101, Y102, V103, F104, G105, T106, Y107, R108, P109, H110, Y111, Y112, Y113, G114, M115, D116, V117, and W118 corresponding to the heavy chain of SEQ ID NO: 294. In some embodiments, when the antibody or fragment thereof is bound to GIPR, GIPR is positioned 5 angstroms or less from at least one residue of the heavy chain of the antibody or fragment thereof selected from the group consisting of M2, G26, Y27, T28, Y32, R98, G100, D101, Y102, F104, G105, Y107, H110, Y111, Y112, Y113, and D116 corresponding to the heavy chain of SEQ ID NO: 294. In some embodiments, when the antibody or fragment thereof is bound to GIPR, GIPR is positioned 5 angstroms or less from at least 2, 3, 4, 5, 6, 7, 8, 9, 10, 11, 12, 13, 14, 15, 16, or 17 residues of the heavy chain of the antibody or fragment thereof selected from the group consisting of M2, G26, Y27, T28, Y32, R98, G100, D101, Y102, F104, G105, Y107, H110, Y111, Y112, Y113, and D116 corresponding to the heavy chain of SEQ ID NO: 294.

In some aspects, the invention comprises an antibody or fragment thereof that binds to GIPR, wherein the antibody or fragment thereof binds to GIPR within a location corresponding to residues 32-63 of SEQ ID NO: 137 of the light chain of the antibody or fragment thereof. In some embodiments, when the antibody or fragment thereof is bound to GIPR, GIPR is positioned 8 angstroms or less from at least one residue of the light chain of the antibody or fragment thereof selected from the group consisting of Q32, T33, N35, Y37, K46, L47, L48, I49, Y50, T51, N53, Q54, R55, P56, S57, G58, V59, P60, D61, R62, and F63 corresponding to the light chain of SEQ ID NO: 137. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, 16, 17, 18, 19, 20, or 21 residues of the light chain of the antibody or fragment thereof selected from the group consisting of Q32, T33, N35, Y37, K46, L47, L48, I49, Y50, T51, N53, Q54, R55, P56, S57, G58, V59, P60, D61, R62, and F63 corresponding to the light chain of SEQ ID NO: 137.

In some embodiments, when the antibody or fragment thereof is bound to GIPR, GIPR is positioned 5 angstroms or less from at least one residue of the light chain of the antibody or fragment thereof selected from the group consisting of L47, Y50, Q54, R55, P56, S57, G58, V59, or D61 corresponding to the light chain of SEQ ID NO: 137. In some embodiments, when the antibody or fragment thereof is bound to GIPR, GIPR is positioned 5 angstroms or less from at least 2, 3, 4, 5, 6, 7, 8, or 9 residues of the light chain of the antibody or fragment thereof selected from the group consisting of L47, Y50, Q54, R55, P56, S57, G58, V59, or D61 corresponding to the light chain of SEQ ID NO: 137.

In some aspects, the invention comprises an antibody or fragment thereof that binds to GIPR, wherein the antibody or fragment thereof binds to GIPR within a location corresponding to residues 1-118 of SEQ ID NO: 294 of the heavy chain of the antibody or fragment thereof and within a location corresponding to residues 32-63 of SEQ ID NO: 137 of the light chain of the antibody or fragment thereof. In some embodiments, when the antibody or fragment thereof is bound to GIPR, GIPR is positioned 8 angstroms or less from at least one residue of the heavy chain of the antibody or fragment thereof selected from the group consisting of Q1, M2, S25, G26, Y27, T28, F29, T30, G31, Y32, N54, R98, G99, G100, D101, Y102, V103, F104, G105, T106, Y107, R108, P109, H110, Y111, Y112, Y113, G114, M115, D116, V117, and W118 corresponding to the heavy chain of SEQ ID NO: 294; and 8 angstroms or less from at least one residue of the light chain of the antibody or fragment thereof selected from the group consisting of Q32, T33, N35, Y37, K46, L47, L48, I49, Y50, T51, N53, Q54, R55, P56, S57, G58, V59, P60, D61, R62, and F63 corresponding to the light chain of SEQ ID NO: 137. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, or 32 residues of the heavy chain of the antibody or fragment thereof selected from the group consisting of Q1, M2, S25, G26, Y27, T28, F29, T30, G31, Y32, N54, R98, G99, G100, D101, Y102, V103, F104, G105, T106, Y107, R108, P109, H110, Y111, Y112, Y113, G114, M115, D116, V117, and W118 corresponding to the heavy chain of SEQ ID NO: 294; and 8 angstroms or less from at least 2, 3, 4, 5, 6, 7, 8, 9, 10, 11, 12, 13, 14, 15, 16, 17, 18, 19, 20, or 21 residues of the light chain of the antibody or fragment thereof selected from the group consisting of Q32, T33, N35, Y37, K46, L47, L48, I49, Y50, T51, N53, Q54, R55, P56, S57, G58, V59, P60, D61, R62, and F63 corresponding to the light chain of SEQ ID NO: 137.

In some embodiments, when the antibody or fragment thereof is bound to GIPR, GIPR is positioned 5 angstroms or less from at least one residue of the heavy chain of the antibody or fragment thereof selected from the group consisting of M2, G26, Y27, T28, Y32, R98, G100, D101, Y102, F104, G105, Y107, H110, Y111, Y112, Y113, and D116 corresponding to the heavy chain of SEQ ID NO: 294; and 5 angstroms or less from at least one residue of the light chain of the antibody or fragment thereof selected from the group consisting of L47, Y50, Q54, R55, P56, S57, G58, V59, or D61 corresponding to the light chain of SEQ ID NO: 137. In some embodiments, when the antibody or fragment thereof is bound to GIPR, GIPR is positioned 5 angstroms or less from at least 2, 3, 4, 5, 6, 7, 8, 9, 10, 11, 12, 13, 14, 15, 16, or 17 residues of the heavy chain of the antibody or fragment thereof selected from the group consisting of M2, G26, Y27, T28, Y32, R98, G100, D101, Y102, F104, G105, Y107, H110, Y111, Y112, Y113, and D116 corresponding to the heavy chain of SEQ ID NO: 294; and 5 angstroms or less from at least 2, 3, 4, 5, 6, 7, 8, or 9 residues of the light chain of the antibody or fragment thereof selected from the group consisting of L47, Y50, Q54, R55, P56, S57, G58, V59, or D61 corresponding to the light chain of SEQ ID NO: 137.

In some aspects, the invention comprises an antibody or fragment thereof that binds to GIPR, wherein the antibody or fragment thereof binds to GIPR within a location corresponding to residues 26-110 of SEQ ID NO: 208 of the heavy chain of the antibody or fragment thereof. In some embodiments, when the antibody or fragment thereof is bound to GIPR, GIPR is positioned 8 angstroms or less from at least one residue of the heavy chain of the antibody or fragment thereof selected from the group consisting of G26, F27, T28, F29, S30, Y31, F32, W52, Y53, D54, S56, N57, Y59, N74, N77, R98, D99, G100, T101, I102, F103, G104, V105, L106, L107, D109, and Y110 corresponding to the heavy chain of SEQ ID NO: 208. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, 16, 17, 18, 19, 20, 21, 22, 23, 24, 25, 26, or 27 residues of the heavy chain of the antibody or fragment thereof selected from the group consisting of G26, F27, T28, F29, S30, Y31, F32, W52, Y53, D54, S56, N57, Y59, N74, N77, R98, D99, G100, T101, I102, F103, G104, V105, L106, L107, D109, and Y110 corresponding to the heavy chain of SEQ ID NO: 208.

In some embodiments, when the antibody or fragment thereof is bound to GIPR, GIPR is positioned 5 angstroms or less from at least one residue of the heavy chain of the antibody or fragment thereof selected from the group consisting of T28, Y31, F32, W52, Y53, R98, G100, T101, I102, F103, G104, V105, and L106 corresponding to the heavy chain of SEQ ID NO: 208. In some embodiments, when the antibody or fragment thereof is bound to GIPR, GIPR is positioned 5 angstroms or less from at least 2, 3, 4, 5, 6, 7, 8, 9, 10, 11, or 12 residues of the heavy chain of the antibody or fragment thereof selected from the group consisting of T28, Y31, F32, W52, Y53, R98, G100, T101, I102, F103, G104, V105, and L106 corresponding to the heavy chain of SEQ ID NO: 208.

In some aspects, the invention comprises an antibody or fragment thereof that binds to GIPR, wherein the antibody or fragment thereof binds to GIPR within a location corresponding to residues 29-96 of SEQ ID NO: 51 of the light chain of the antibody or fragment thereof. In some embodiments, when the antibody or fragment thereof is bound to GIPR, GIPR is positioned 8 angstroms or less from at least one residue of the light chain of the antibody or fragment thereof selected from the group consisting of I29, R30, D31, Y32, L33, L46, I48, Y49, G50, A51, S52, S53, L54, Q55, S56, Q90, H91, N92, N93, Y94, and F96 corresponding to the light chain of SEQ ID NO: 51. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, 16, 17, 18, 19, 20, or 21 residues of the light chain of the antibody or fragment thereof selected from the group consisting of I29, R30, D31, Y32, L33, L46, I48, Y49, G50, A51, S52, S53, L54, Q55, S56, Q90, H91, N92, N93, Y94, and F96 corresponding to the light chain of SEQ ID NO: 51.

In some embodiments, when the antibody or fragment thereof is bound to GIPR, GIPR is positioned 5 angstroms or less from at least one residue of the light chain of the antibody or fragment thereof selected from the group consisting of Y32, Y49, G50, S53, Q55, H91, N92, N93, and Y94 corresponding to the light chain of SEQ ID NO: 51. In some embodiments, when the antibody or fragment thereof is bound to GIPR, GIPR is positioned 5 angstroms or less from at least 2, 3, 4, 5, 6, 7, 8, or 9 residues of the light chain of the antibody or fragment thereof selected from the group consisting Y32, Y49, G50, S53, Q55, H91, N92, N93, and Y94 corresponding to the light chain of SEQ ID NO: 51.

In some aspects, the invention comprises an antibody or fragment thereof that binds to GIPR, wherein the antibody or fragment thereof binds to GIPR within a location corresponding to residues 26-110 of SEQ ID NO: 208 of the heavy chain of the antibody or fragment thereof and within a location corresponding to residues 29-96 of SEQ ID NO: 51 of the light chain of the antibody or fragment thereof. In some embodiments, when the antibody or fragment thereof is bound to GIPR, GIPR is positioned 8 angstroms or less from at least one residue of the heavy chain of the antibody or fragment thereof selected from the group consisting of G26, F27, T28, F29, S30, Y31, F32, W52, Y53, D54, S56, N57, Y59, N74, N77, R98, D99, G100, T101, I102, F103, G104, V105, L106, L107, D109, and Y110 corresponding to the heavy chain of SEQ ID NO: 208; and 8 angstroms or less from at least one residue of the light chain of the antibody or fragment thereof selected from the group consisting of I29, R30, D31, Y32, L33, L46, I48, Y49, G50, A51, S52, S53, L54, Q55, S56, Q90, H91, N92, N93, Y94, and F96 corresponding to the light chain of SEQ ID NO: 51. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, 16, 17, 18, 19, 20, 21, 22, 23, 24, 25, 26, or 27 residues of the heavy chain of the antibody or fragment thereof selected from the group consisting of G26, F27, T28, F29, S30, Y31, F32, W52, Y53, D54, S56, N57, Y59, N74, N77, R98, D99, G100, T101, I102, F103, G104, V105, L106, L107, D109, and Y110 corresponding to the heavy chain of SEQ ID NO: 208; and 8 angstroms or less from at least 2, 3, 4, 5, 6, 7, 8, 9, 10, 11, 12, 13, 14, 15, 16, 17, 18, 19, 20, or 21 residues of the light chain of the antibody or fragment thereof selected from the group consisting of I29, R30, D31, Y32, L33, L46, I48, Y49, G50, A51, S52, S53, L54, Q55, S56, Q90, H91, N92, N93, Y94, and F96 corresponding to the light chain of SEQ ID NO: 51.

In some embodiments, when the antibody or fragment thereof is bound to GIPR, GIPR is positioned 5 angstroms or less from at least one residue of the heavy chain of the antibody or fragment thereof selected from the group consisting of T28, Y31, F32, W52, Y53, R98, G100, T101, I102, F103, G104, V105, and L106 corresponding to the heavy chain of SEQ ID NO: 208; and 5 angstroms or less from at least one residue of the light chain of the antibody or fragment thereof selected from the group consisting of Y32, Y49, G50, S53, Q55, H91, N92, N93, and Y94 corresponding to the light chain of SEQ ID NO: 51. In some embodiments, when the antibody or fragment thereof is bound to GIPR, GIPR is positioned 5 angstroms or less from at least 2, 3, 4, 5, 6, 7, 8, 9, 10, 11, or 12 residues of the heavy chain of the antibody or fragment thereof selected from the group consisting of T28, Y31, F32, W52, Y53, R98, G100, T101, I102, F103, G104, V105, and L106 corresponding to the heavy chain of SEQ ID NO: 208; and 5 angstroms or less from at least 2, 3, 4, 5, 6, 7, 8, or 9 residues of the light chain of the antibody or fragment thereof selected from the group consisting Y32, Y49, G50, S53, Q55, H91, N92, N93, and Y94 corresponding to the light chain of SEQ ID NO: 51.

In some aspects, the invention comprises an antibody or fragment thereof that binds to GIPR, wherein the antibody or fragment thereof binds to GIPR within a location corresponding to residues 30-106 of SEQ ID NO: 171 of the heavy chain of the antibody or fragment thereof. In some embodiments, when the antibody or fragment thereof is bound to GIPR, GIPR is positioned 8 angstroms or less from at least one residue of the heavy chain of the antibody or fragment thereof selected from the group consisting of S30, S31, Y32, Y33, Y52, R97, D98, V99, A100, V101, A102, G103, F104, D105, and Y106 corresponding to the heavy chain of SEQ ID NO: 171. In some embodiments, when the antibody or fragment thereof is bound to GIPR, GIPR is positioned 8 angstroms or less from at least 2, 3, 4, 5, 6, 7, 8, 9, 10, 11, 12, 13, 14, or 15 residues of the heavy chain of the antibody or fragment thereof selected from the group consisting of S30, S31, Y32, Y33, Y52, R97, D98, V99, A100, V101, A102, G103, F104, D105, and Y106 corresponding to the heavy chain of SEQ ID NO: 171.

In some embodiments, when the antibody or fragment thereof is bound to GIPR, GIPR is positioned 5 angstroms or less from at least one residue of the heavy chain of the antibody or fragment thereof selected from the group consisting of S30, S31, Y32, Y52, R97, D98, V99, A100, V101, A102, and D105 corresponding to the heavy chain of SEQ ID NO: 171. In some embodiments, when the antibody or fragment thereof is bound to GIPR, GIPR is positioned 5 angstroms or less from at least 2, 3, 4, 5, 6, 7, 8, 9, 10, or 11 residues of the heavy chain of the antibody or fragment thereof selected from the group consisting of S30, S31, Y32, Y52, R97, D98, V99, A100, V101, A102, and D105 corresponding to the heavy chain of SEQ ID NO: 171.

In some aspects, the invention comprises an antibody or fragment thereof that binds to GIPR, wherein the antibody or fragment thereof binds to GIPR within a location corresponding to residues 27-94 of SEQ ID NO: 14 of the light chain of the antibody or fragment thereof. In some embodiments, when the antibody or fragment thereof is bound to GIPR, GIPR is positioned 8 angstroms or less from at least one residue of the light chain of the antibody or fragment thereof selected from the group consisting of Q27, G28, L29, I30, I31, W32, A34, L46, L47, I48, Y49, A50, A51, S52, S53, L54, Q55, S56, G57, S65, G66, S67, G68, F71, Q90, T91, N92, S93, and F94 corresponding to the light chain of SEQ ID NO: 14. In some embodiments, when the antibody or fragment thereof is bound to GIPR, GIPR is positioned 8 angstroms or less from at least 2, 3, 4, 5, 6, 7, 8, 9, 10, 11, 12, 13, 14, 15, 16, 17, 18, 19, 20, 21, 22, 23, 24, 25, 26, 27, 28, or 29 residues of the light chain of the antibody or fragment thereof selected from the group consisting of Q27, G28, L29, I30, I31, W32, A34, L46, L47, I48, Y49, A50, A51, S52, S53, L54, Q55, S56, G57, S65, G66, S67, G68, F71, Q90, T91, N92, S93, and F94 corresponding to the light chain of SEQ ID NO: 14.

In some embodiments, when the antibody or fragment thereof is bound to GIPR, GIPR is positioned 5 angstroms or less from at least one residue of the light chain of the antibody or fragment thereof selected from the group consisting of I30, I31, W32, L46, Y49, S52, S53, L54, Q55, S56, S67, T91, and N92 corresponding to the light chain of SEQ ID NO: 14. In some embodiments, when the antibody or fragment thereof is bound to GIPR, GIPR is positioned 5 angstroms or less from at least 2, 3, 4, 5, 6, 7, 8, 9, 10, 11, 12, or 13 residues of the light chain of the antibody or fragment thereof selected from the group consisting I30, I31, W32, L46, Y49, S52, S53, L54, Q55, S56, S67, T91, and N92 corresponding to the light chain of SEQ ID NO: 14.

In some aspects, the invention comprises an antibody or fragment thereof that binds to GIPR, wherein the antibody or fragment thereof binds to GIPR within a location corresponding to residues 30-106 of SEQ ID NO: 171 of the heavy chain of the antibody or fragment thereof and corresponding to residues 27-94 of SEQ ID NO: 14 of the light chain of the antibody or fragment thereof. In some embodiments, when the antibody or fragment thereof is bound to GIPR, GIPR is positioned 8 angstroms or less from at least one residue of the heavy chain of the antibody or fragment thereof selected from the group consisting of S30, S31, Y32, Y33, Y52, R97, D98, V99, A100, V101, A102, G103, F104, D105, and Y106 corresponding to the heavy chain of SEQ ID NO: 171; and 8 angstroms or less from at least one residue of the light chain of the antibody or fragment thereof selected from the group consisting of Q27, G28, L29, I30, I31, W32, A34, L46, L47, I48, Y49, A50, A51, S52, S53, L54, Q55, S56, G57, S65, G66, S67, G68, F71, Q90, T91, N92, S93, and F94 corresponding to the light chain of SEQ ID NO: 14. In some embodiments, when the antibody or fragment thereof is bound to GIPR, GIPR is positioned 8 angstroms or less from at least 2, 3, 4, 5, 6, 7, 8, 9, 10, 11, 12, 13, 14, or 15 residues of the heavy chain of the antibody or fragment thereof selected from the group consisting of S30, S31, Y32, Y33, Y52, R97, D98, V99, A100, V101, A102, G103, F104, D105, and Y106 corresponding to the heavy chain of SEQ ID NO: 171; and 8 angstroms or less from at least 2, 3, 4, 5, 6, 7, 8, 9, 10, 11, 12, 13, 14, 15, 16, 17, 18, 19, 20, 21, 22, 23, 24, 25, 26, 27, 28, or 29 residues of the light chain of the antibody or fragment thereof selected from the group consisting of Q27, G28, L29, I30, I31, W32, A34, L46, L47, I48, Y49, A50, A51, S52, S53, L54, Q55, S56, G57, S65, G66, S67, G68, F71, Q90, T91, N92, S93, and F94 corresponding to the light chain of SEQ ID NO: 14.

In some embodiments, when the antibody or fragment thereof is bound to GIPR, GIPR is positioned 5 angstroms or less from at least one residue of the heavy chain of the antibody or fragment thereof selected from the group consisting of S30, S31, Y32, Y52, R97, D98, V99, A100, V101, A102, and D105 corresponding to the heavy chain of SEQ ID NO: 171; and 5 angstroms or less from at least one residue of the light chain of the antibody or fragment thereof selected from the group consisting of I30, I31, W32, L46, Y49, S52, S53, L54, Q55, S56, S67, T91, and N92 corresponding to the light chain of SEQ ID NO: 14. In some embodiments, when the antibody or fragment thereof is bound to GIPR, GIPR is positioned 5 angstroms or less from at least 2, 3, 4, 5, 6, 7, 8, 9, 10, or 11 residues of the heavy chain of the antibody or fragment thereof selected from the group consisting of S30, S31, Y32, Y52, R97, D98, V99, A100, V101, A102, and D105 corresponding to the heavy chain of SEQ ID NO: 171; and 5 angstroms or less from at least 2, 3, 4, 5, 6, 7, 8, 9, 10, 11, 12, or 13 residues of the light chain of the antibody or fragment thereof selected from the group consisting I30, I31, W32, L46, Y49, S52, S53, L54, Q55, S56, S67, T91, and N92 corresponding to the light chain of SEQ ID NO: 14.

In another aspect, the antigen binding protein comprises a full length light chain and a full length heavy chain as listed in one of the rows for one of the antibodies listed in TABLE 5. Some antigen binding proteins that are provided comprise a full length light chain and a full length heavy chain as listed in one of the rows for one of the antibodies listed in TABLE 5, except that one or both of the chains differs from the sequence specified in the table at only 1, 2, 3, 4, 5, 6, 7, 8, 9, 10, 11, 12, 13, 14 or 15 amino acid residues, wherein each such sequence difference is independently either a single amino acid deletion, insertion or substitution, with the deletions, insertions and/or substitutions resulting in no more than 1, 2, 3, 4, 5, 6, 7, 8, 9, 10, 11, 12, 13, 14 or 15 amino acid changes relative to the full length sequences specified in TABLE 5. In one embodiment the antigen binding protein comprises a full length light chain and/or a full length heavy chain from Table 5 with the N-terminal methionine deleted. In one embodiment the antigen binding protein comprises a full length light chain and/or a full length heavy chain from Table 5 with the C-terminal lysine deleted. Other antigen binding proteins also comprise a full length light chain and a full length heavy chain as listed in one of the rows for one of the antibodies listed in TABLE 5, except that one or both of the chains differs from the sequence specified in the table in that the light chain and/or heavy chain comprises or consists of a sequence of amino acids that has at least 70%, 75%, 80%, 85%, 90%, 95%, 96%, 97%, 98%, or 99% sequence identity to the amino acid sequences of the light chain or heavy chain sequences as specified in TABLE 5.

In another embodiment, the antigen binding protein consists of a just a light or a heavy chain polypeptide as set forth in TABLE 5.

In still another aspect, antigen-binding proteins containing the CDRs, variable domains and/or full length sequences listed in TABLES 3, 4A, 4B, and 5 is a monoclonal antibody, a chimeric antibody, a humanized antibody, a human antibody, a multispecific antibody, or an antibody fragment of the foregoing. In another embodiment, the antibody fragment of the isolated antigen-binding proteins provided herein is a Fab fragment, a Fab' fragment, an F(ab')2 fragment, an Fv fragment, a diabody, or a scFv based upon an antibody with the sequences as listed in TABLE 5.

In yet another aspect, the isolated antigen-binding protein provided in TABLE 5 can be coupled to a labeling group and can compete for binding to GIPR with an antigen binding protein of one of the isolated antigen-binding proteins provided herein.

In another embodiment, antigen binding proteins are provided that compete with one of the exemplified antibodies or functional fragments described above for specific binding to a human GIPR (e.g., SEQ ID NO: 3141). Such antigen binding proteins may bind to the same epitope as one of the antigen binding proteins described herein, or to an overlapping epitope. Antigen binding proteins and fragments that compete with the exemplified antigen binding proteins are expected to show similar functional properties. The exemplified antigen binding proteins and fragments include those described above, including those with heavy and light chains, variable region domains and CDRs included in TABLES 3, 4A, 4B, and 5. Thus, as a specific example, the antigen binding proteins that are provided include those that compete with an antibody having:

all 6 of the CDRs listed for any antibody listed in TABLES 4A and 4B;

a VH and a VL listed for any antibody listed in TABLE 3; or two light chains and two heavy chains as specified for any antibody listed in TABLE 5.

The antigen binding proteins that are provided include monoclonal antibodies that bind to GIPR. Monoclonal antibodies may be produced using any technique known in the art, e.g., by immortalizing spleen cells harvested from the transgenic animal after completion of the immunization schedule. The spleen cells can be immortalized using any technique known in the art, e.g., by fusing them with myeloma cells to produce hybridomas. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas). Examples of suitable cell lines for use in mouse fusions include Sp-20, P3-X63/Ag8, P3-X63-Ag8.653, NS1/1.Ag 4 1, Sp210-Ag14, FO, NSO/U, MPC-11, MPC11-X45-GTG 1.7 and S194/5XXO Bul; examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6.

In some instances, a hybridoma cell line is produced by immunizing an animal (e.g., a transgenic animal having human immunoglobulin sequences) with a GIPR immunogen; harvesting spleen cells from the immunized animal; fusing the harvested spleen cells to a myeloma cell line, thereby generating hybridoma cells; establishing hybridoma cell lines from the hybridoma cells, and identifying a hybridoma cell line that produces an antibody that binds a GIPR polypeptide. Such hybridoma cell lines, and anti-GIPR monoclonal antibodies produced by them, are aspects of the present application.

Monoclonal antibodies secreted by a hybridoma cell line can be purified using any technique known in the art. Hybridomas or mAbs may be further screened to identify mAbs with particular properties, such as the ability to increase GIPR activity.

Chimeric and humanized antibodies based upon the foregoing sequences are also provided. Monoclonal antibodies for use as therapeutic agents may be modified in various ways prior to use. One example is a chimeric antibody, which is an antibody composed of protein segments from different antibodies that are covalently joined to produce functional immunoglobulin light or heavy chains or immunologically functional portions thereof. Generally, a portion of the heavy chain and/or light chain is identical with or homologous to a corresponding sequence in antibodies derived from a particular species or belonging to a particular antibody class or subclass, while the remainder of the chain(s) is/are identical with or homologous to a corresponding sequence in antibodies derived from another species or belonging to another antibody class or subclass. For methods relating to chimeric antibodies, see, for example, U.S. Pat. No. 4,816,567; and Morrison et al., 1985, *Proc. Natl. Acad. Sci. USA* 81:6851-6855, which are hereby incorporated by reference. CDR grafting is described, for example, in U.S. Pat. Nos. 6,180,370, 5,693,762, 5,693,761, 5,585,089, and No. 5,530,101.

Generally, the goal of making a chimeric antibody is to create a chimera in which the number of amino acids from the intended patient species is maximized. One example is the "CDR-grafted" antibody, in which the antibody comprises one or more complementarity determining regions (CDRs) from a particular species or belonging to a particular antibody class or subclass, while the remainder of the antibody chain(s) is/are identical with or homologous to a corresponding sequence in antibodies derived from another species or belonging to another antibody class or subclass. For use in humans, the variable region or selected CDRs from a rodent antibody often are grafted into a human antibody, replacing the naturally-occurring variable regions or CDRs of the human antibody.

One useful type of chimeric antibody is a "humanized" antibody. Generally, a humanized antibody is produced from a monoclonal antibody raised initially in a non-human animal. Certain amino acid residues in this monoclonal antibody, typically from non-antigen recognizing portions of the antibody, are modified to be homologous to corresponding residues in a human antibody of corresponding isotype. Humanization can be performed, for example, using various methods by substituting at least a portion of a rodent variable region for the corresponding regions of a human antibody (see, e.g., U.S. Pat. Nos. 5,585,089, and 5,693,762; Jones et al., 1986, *Nature* 321:522-525; Riechmann et al., 1988, *Nature* 332:323-27; Verhoeyen et al., 1988, *Science* 239: 1534-1536).

In one aspect, the CDRs of the light and heavy chain variable regions of the antibodies provided herein are grafted to framework regions (FRs) from antibodies from the same, or a different, phylogenetic species. For example, the CDRs of the heavy and light chain variable regions $V_H1$, $V_H2$, $V_H3$, $V_H4$, $V_H5$, $V_H6$, $V_H7$, $V_H8$, $V_H9$, $V_H10$, $V_H11$, $V_H12$ and/or $V_L1$, and $V_L2$ can be grafted to consensus human FRs. To create consensus human FRs, FRs from several human heavy chain or light chain amino acid sequences may be aligned to identify a consensus amino acid sequence. In other embodiments, the FRs of a heavy chain or light chain disclosed herein are replaced with the FRs from a different heavy chain or light chain. In one aspect, rare amino acids in the FRs of the heavy and light chains of GIPR antibodies are not replaced, while the rest of the FR amino acids are replaced. A "rare amino acid" is a specific amino acid that is in a position in which this particular amino acid is not usually found in an FR. Alternatively, the grafted variable regions from the one heavy or light chain may be used with a constant region that is different from the constant region of that particular heavy or light chain as disclosed herein. In other embodiments, the grafted variable regions are part of a single chain Fv antibody.

In certain embodiments, constant regions from species other than human can be used along with the human variable region(s) to produce hybrid antibodies.

Fully human GIPR antibodies are also provided. Methods are available for making fully human antibodies specific for a given antigen without exposing human beings to the antigen ("fully human antibodies"). One specific means provided for implementing the production of fully human antibodies is the "humanization" of the mouse humoral immune system. Introduction of human immunoglobulin (Ig) loci into mice in which the endogenous Ig genes have been inactivated is one means of producing fully human monoclonal antibodies (mAbs) in mouse, an animal that can be immunized with any desirable antigen. Using fully human antibodies can minimize the immunogenic and allergic responses that can sometimes be caused by administering mouse or mouse-derived mAbs to humans as therapeutic agents.

Fully human antibodies can be produced by immunizing transgenic animals (usually mice) that are capable of producing a repertoire of human antibodies in the absence of endogenous immunoglobulin production. Antigens for this purpose typically have six or more contiguous amino acids, and optionally are conjugated to a carrier, such as a hapten. See, e.g., Jakobovits et al., 1993, *Proc. Natl. Acad. Sci. USA* 90:2551-2555; Jakobovits et al., 1993, *Nature* 362:255-258; and Bruggermann et al., 1993, *Year in Immunol.* 7:33. In one example of such a method, transgenic animals are produced by incapacitating the endogenous mouse immunoglobulin loci encoding the mouse heavy and light immunoglobulin chains therein, and inserting into the mouse genome large fragments of human genome DNA containing loci that encode human heavy and light chain proteins. Partially modified animals, which have less than the full complement of human immunoglobulin loci, are then cross-bred to obtain an animal having all of the desired immune system modifications. When administered an immunogen, these transgenic animals produce antibodies that are immunospecific for the immunogen but have human rather than murine amino acid sequences, including the variable regions. For further details of such methods, see, for example, WO96/33735 and WO94/02602. Additional methods relating to transgenic mice for making human antibodies are described in U.S. Pat. Nos. 5,545,807; 6,713,610; 6,673,986; 6,162,963; 5,545,807; 6,300,129; 6,255,458; 5,877,397; 5,874,299 and 5,545,806; in PCT publications WO91/10741, WO90/04036, and in EP 546073B1 and EP 546073A1.

The transgenic mice described above, referred to herein as "HuMab" mice, contain a human immunoglobulin gene minilocus that encodes unrearranged human heavy ([mu] and [gamma]) and [kappa] light chain immunoglobulin sequences, together with targeted mutations that inactivate the endogenous [mu] and [kappa] chain loci (Lonberg et al., 1994, *Nature* 368:856-859). Accordingly, the mice exhibit reduced expression of mouse IgM or [kappa] and in response to immunization, and the introduced human heavy and light chain transgenes undergo class switching and somatic mutation to generate high affinity human IgG [kappa] monoclonal antibodies (Lonberg et al., supra.; Lonberg and Huszar, 1995, *Intern. Rev. Immunol.* 13: 65-93; Harding and Lonberg, 1995, *Ann. N.Y Acad. Sci.* 764:536-546). The preparation of HuMab mice is described in detail in Taylor et al., 1992, *Nucleic Acids Research* 20:6287-6295; Chen et al., 1993, *International Immunology* 5:647-656; Tuaillon et al., 1994, *J. Immunol.* 152:2912-2920; Lonberg et al., 1994, *Nature* 368:856-859; Lonberg, 1994, *Handbook of Exp. Pharmacology* 113:49-101; Taylor et al., 1994, *International Immunology* 6:579-591; Lonberg and Huszar, 1995, *Intern. Rev. Immunol.* 13:65-93; Harding and Lonberg, 1995, *Ann. N.Y Acad. Sci.* 764:536-546; Fishwild et al., 1996, *Nature Biotechnology* 14:845-851; the foregoing references are hereby incorporated by reference in their entirety for all purposes. See, further U.S. Pat. No. 5,545,806;

5,569,825; 5,625,126; 5,633,425; 5,789,650; 5,877,397; 5,661,016; 5,814,318; 5,874,299; and 5,770,429; as well as U.S. Pat. No. 5,545,807; International Publication Nos. WO 93/1227; WO 92/22646; and WO 92/03918, the disclosures of all of which are hereby incorporated by reference in their entirety for all purposes. Technologies utilized for producing human antibodies in these transgenic mice are disclosed also in WO 98/24893, and Mendez et al., 1997, *Nature Genetics* 15:146-156, which are hereby incorporated by reference. For example, the HCo7 and HCo12 transgenic mice strains can be used to generate human monoclonal antibodies against GIPR. Further details regarding the production of human antibodies using transgenic mice are provided below.

Using hybridoma technology, antigen-specific human mAbs with the desired specificity can be produced and selected from the transgenic mice such as those described above. Such antibodies may be cloned and expressed using a suitable vector and host cell, or the antibodies can be harvested from cultured hybridoma cells.

Fully human antibodies can also be derived from phage-display libraries (as disclosed in Hoogenboom et al., 1991, *J. Mol. Biol.* 227:381; and Marks et al., 1991, *J. Mol. Biol.* 222:581). Phage display techniques mimic immune selection through the display of antibody repertoires on the surface of filamentous bacteriophage, and subsequent selection of phage by their binding to an antigen of choice. One such technique is described in PCT Publication No. WO 99/10494 (hereby incorporated by reference).

The GIPR binding protein can also be a variant, mimetic, derivative or oligomer based upon the structure of GIPR antigen binding proteins have the CDRs, variable regions and/or full length chains as described above.

In one embodiment, for instance, an antigen binding protein is a variant form of the antigen binding proteins disclosed above. For instance, some of the antigen binding proteins have one or more conservative amino acid substitutions in one or more of the heavy or light chains, variable regions or CDRs.

Naturally-occurring amino acids may be divided into classes based on common side chain properties:
1) hydrophobic: norleucine, Met, Ala, Val, Leu, Ile;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties.

Non-conservative substitutions may involve the exchange of a member of one of the above classes for a member from another class. Such substituted residues may be introduced into regions of the antibody that are homologous with human antibodies, or into the non-homologous regions of the molecule.

In making such changes, according to certain embodiments, the hydropathic index of amino acids may be considered. The hydropathic profile of a protein is calculated by assigning each amino acid a numerical value ("hydropathy index") and then repetitively averaging these values along the peptide chain. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic profile in conferring interactive biological function on a protein is understood in the art (see, e.g., Kyte et al., 1982, *J. Mol. Biol.* 157:105-131). It is known that certain amino acids may be substituted for other amino acids having a similar hydropathic index or score and still retain a similar biological activity. In making changes based upon the hydropathic index, in certain embodiments, the substitution of amino acids whose hydropathic indices are within ±2 is included. In some aspects, those which are within ±1 are included, and in other aspects, those within ±0.5 are included.

It is also understood in the art that the substitution of like amino acids can be made effectively on the basis of hydrophilicity, particularly where the biologically functional protein or peptide thereby created is intended for use in immunological embodiments, as in the present case. In certain embodiments, the greatest local average hydrophilicity of a protein, as governed by the hydrophilicity of its adjacent amino acids, correlates with its immunogenicity and antigen-binding or immunogenicity, that is, with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in other embodiments, those which are within ±1 are included, and in still other embodiments, those within ±0.5 are included. In some instances, one may also identify epitopes from primary amino acid sequences on the basis of hydrophilicity. These regions are also referred to as "epitopic core regions."

Exemplary conservative amino acid substitutions are set forth in Table 6.

TABLE 8

Conservative Amino Acid Substitutions

| Original Residue | Exemplary Substitutions |
|---|---|
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |

TABLE 8-continued

Conservative Amino Acid Substitutions

| Original Residue | Exemplary Substitutions |
|---|---|
| Tyr | Trp, Phe |
| Val | Ile, Leu |

A skilled artisan will be able to determine suitable variants of polypeptides as set forth herein using well-known techniques. One skilled in the art may identify suitable areas of the molecule that may be changed without destroying activity by targeting regions not believed to be important for activity. The skilled artisan also will be able to identify residues and portions of the molecules that are conserved among similar polypeptides. In further embodiments, even areas that may be important for biological activity or for structure may be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues important for activity or structure in similar proteins. One skilled in the art may opt for chemically similar amino acid substitutions for such predicted important amino acid residues.

One skilled in the art can also analyze the 3-dimensional structure and amino acid sequence in relation to that structure in similar polypeptides. In view of such information, one skilled in the art may predict the alignment of amino acid residues of an antibody with respect to its three dimensional structure. One skilled in the art may choose not to make radical changes to amino acid residues predicted to be on the surface of the protein, since such residues may be involved in important interactions with other molecules. Moreover, one skilled in the art may generate test variants containing a single amino acid substitution at each desired amino acid residue. These variants can then be screened using assays for GIPR activity, thus yielding information regarding which amino acids can be changed and which must not be changed. In other words, based on information gathered from such routine experiments, one skilled in the art can readily determine the amino acid positions where further substitutions should be avoided either alone or in combination with other mutations.

A number of scientific publications have been devoted to the prediction of secondary structure. See, Moult, 1996, *Curr. Op. in Biotech.* 7:422-427; Chou et al., 1974, *Biochem.* 13:222-245; Chou et al., 1974, *Biochemistry* 113:211-222; Chou et al., 1978, *Adv. Enzymol. Relat. Areas Mol. Biol.* 47:45-148; Chou et al., 1979, *Ann. Rev. Biochem.* 47:251-276; and Chou et al., 1979, *Biophys. J.* 26:367-384. Moreover, computer programs are currently available to assist with predicting secondary structure. One method of predicting secondary structure is based upon homology modeling. For example, two polypeptides or proteins that have a sequence identity of greater than 30%, or similarity greater than 40% can have similar structural topologies. The recent growth of the protein structural database (PDB) has provided enhanced predictability of secondary structure, including the potential number of folds within a polypeptide's or protein's structure. See, Holm et al., 1999, *Nucl. Acid. Res.* 27:244-247. It has been suggested (Brenner et al., 1997, *Curr. Op. Struct. Biol.* 7:369-376) that there are a limited number of folds in a given polypeptide or protein and that once a critical number of structures have been resolved, structural prediction will become dramatically more accurate.

Additional methods of predicting secondary structure include "threading" (Jones, 1997, *Curr. Opin. Struct. Biol.* 7:377-387; Sippl et al., 1996, *Structure* 4:15-19), "profile analysis" (Bowie et al., 1991, *Science* 253:164-170; Gribskov et al., 1990, *Meth. Enzym.* 183:146-159; Gribskov et al., 1987, *Proc. Nat. Acad. Sci.* 84:4355-4358), and "evolutionary linkage" (See, Holm, 1999, supra; and Brenner, 1997, supra).

In some embodiments, amino acid substitutions are made that: (1) reduce susceptibility to proteolysis, (2) reduce susceptibility to oxidation, (3) alter binding affinity for forming protein complexes, (4) alter ligand or antigen binding affinities, and/or (4) confer or modify other physicochemical or functional properties on such polypeptides. For example, single or multiple amino acid substitutions (in certain embodiments, conservative amino acid substitutions) may be made in the naturally-occurring sequence. Substitutions can be made in that portion of the antibody that lies outside the domain(s) forming intermolecular contacts). In such embodiments, conservative amino acid substitutions can be used that do not substantially change the structural characteristics of the parent sequence (e.g., one or more replacement amino acids that do not disrupt the secondary structure that characterizes the parent or native antigen binding protein). Examples of art-recognized polypeptide secondary and tertiary structures are described in Proteins, Structures and Molecular Principles (Creighton, Ed.), 1984, W. H. New York: Freeman and Company; Introduction to Protein Structure (Branden and Tooze, eds.), 1991, New York: Garland Publishing; and Thornton et al., 1991, *Nature* 354:105, which are each incorporated herein by reference.

Additional preferred antibody variants include cysteine variants wherein one or more cysteine residues in the parent or native amino acid sequence are deleted from or substituted with another amino acid (e.g., serine). Cysteine variants are useful, inter alia when antibodies must be refolded into a biologically active conformation. Cysteine variants may have fewer cysteine residues than the native antibody, and typically have an even number to minimize interactions resulting from unpaired cysteines.

The heavy and light chains, variable regions domains and CDRs that are disclosed can be used to prepare polypeptides that contain an antigen binding region that can specifically bind to GIPR. For example, one or more of the CDRs can be incorporated into a molecule (e.g., a polypeptide) covalently or noncovalently to make an immunoadhesion. An immunoadhesion may incorporate the CDR(s) as part of a larger polypeptide chain, may covalently link the CDR(s) to another polypeptide chain, or may incorporate the CDR(s) noncovalently. The CDR(s) enable the immunoadhesion to bind specifically to a particular antigen of interest (e.g., an GIPR polypeptide or epitope thereof).

Mimetics (e.g., "peptide mimetics" or "peptidomimetics") based upon the variable region domains and CDRs that are described herein are also provided. These analogs can be peptides, non-peptides or combinations of peptide and non-peptide regions. Fauchere, 1986, *Adv. Drug Res.* 15:29; Veber and Freidinger, 1985, *TINS* p. 392; and Evans et al., 1987, *J. Med. Chem.* 30:1229, which are incorporated herein by reference for any purpose. Peptide mimetics that are structurally similar to therapeutically useful peptides may be used to produce a similar therapeutic or prophylactic effect.

Such compounds are often developed with the aid of computerized molecular modeling. Generally, peptidomimetics are proteins that are structurally similar to an antibody displaying a desired biological activity, such as here the ability to specifically bind GIPR, but have one or more peptide linkages optionally replaced by a linkage selected from: —$CH_2NH$—, —$CH_2S$—, —$CH_2$—$CH_2$—, —CH═CH-(cis and trans), —$COCH_2$—, —$CH(OH)CH_2$—, and —$CH_2SO$—, by methods well known in the art. Systematic substitution of one or more amino acids of a consensus sequence with a D-amino acid of the same type (e.g., D-lysine in place of L-lysine) may be used in certain embodiments to generate more stable proteins. In addition, constrained peptides comprising a consensus sequence or a substantially identical consensus sequence variation may be generated by methods known in the art (Rizo and Gierasch, 1992, *Ann. Rev. Biochem.* 61:387), incorporated herein by reference), for example, by adding internal cysteine residues capable of forming intramolecular disulfide bridges which cyclize the peptide.

Derivatives of the antigen binding proteins that are described herein are also provided. The derivatized antigen binding proteins can comprise any molecule or substance that imparts a desired property to the antibody or fragment, such as increased half-life in a particular use. The derivatized antigen binding protein can comprise, for example, a detectable (or labeling) moiety (e.g., a radioactive, colorimetric, antigenic or enzymatic molecule, a detectable bead (such as a magnetic or electrodense (e.g., gold) bead), or a molecule that binds to another molecule (e.g., biotin or streptavidin)), a therapeutic or diagnostic moiety (e.g., a radioactive, cytotoxic, or pharmaceutically active moiety), or a molecule that increases the suitability of the antigen binding protein for a particular use (e.g., administration to a subject, such as a human subject, or other in vivo or in vitro uses). Examples of molecules that can be used to derivatize an antigen binding protein include albumin (e.g., human serum albumin) and polyethylene glycol (PEG). Albumin-linked and PEGylated derivatives of antigen binding proteins can be prepared using techniques well known in the art. Certain antigen binding proteins include a pegylated single chain polypeptide as described herein. In one embodiment, the antigen binding protein is conjugated or otherwise linked to transthyretin (TTR) or a TTR variant. The TTR or TTR variant can be chemically modified with, for example, a chemical selected from the group consisting of dextran, poly(n-vinyl pyrrolidone), polyethylene glycols, propropylene glycol homopolymers, polypropylene oxide/ethylene oxide co-polymers, polyoxyethylated polyols and polyvinyl alcohols.

Other derivatives include covalent or aggregative conjugates of GIPR antigen binding proteins with other proteins or polypeptides, such as by expression of recombinant fusion proteins comprising heterologous polypeptides fused to the N-terminus or C-terminus of an GIPR antigen binding protein. For example, the conjugated peptide may be a heterologous signal (or leader) polypeptide, e.g., the yeast alpha-factor leader, or a peptide such as an epitope tag. GIPR antigen binding protein-containing fusion proteins can comprise peptides added to facilitate purification or identification of the GIPR antigen binding protein (e.g., poly-His). A GIPR antigen binding protein also can be linked to the FLAG peptide as described in Hopp et al., 1988, *Bio/Technology* 6:1204; and U.S. Pat. No. 5,011,912. The FLAG peptide is highly antigenic and provides an epitope reversibly bound by a specific monoclonal antibody (mAb), enabling rapid assay and facile purification of expressed recombinant protein. Reagents useful for preparing fusion proteins in which the FLAG peptide is fused to a given polypeptide are commercially available (Sigma, St. Louis, Mo.).

In some embodiments, the antigen binding protein comprises one or more labels. The term "labeling group" or "label" means any detectable label. Examples of suitable labeling groups include, but are not limited to, the following: radioisotopes or radionuclides (e.g., $^{3}H$, $^{14}C$, $^{15}N$, $^{35}S$, $^{90}Y$, $^{99}Tc$, $^{111}In$, $^{125}I$, $^{131}I$), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and may be used as is seen fit.

The term "effector group" means any group coupled to an antigen binding protein that acts as a cytotoxic agent. Examples for suitable effector groups are radioisotopes or radionuclides (e.g., $^{3}H$, $^{14}C$, $^{15}N$, $^{35}S$, $^{90}Y$, $^{99}Tc$, $^{111}In$, $^{125}I$, $^{131}I$). Other suitable groups include toxins, therapeutic groups, or chemotherapeutic groups. Examples of suitable groups include calicheamicin, auristatins, geldanamycin and maytansine. In some embodiments, the effector group is coupled to the antigen binding protein via spacer arms of various lengths to reduce potential steric hindrance.

In general, labels fall into a variety of classes, depending on the assay in which they are to be detected: a) isotopic labels, which may be radioactive or heavy isotopes; b) magnetic labels (e.g., magnetic particles); c) redox active moieties; d) optical dyes; enzymatic groups (e.g. horseradish peroxidase, β-galactosidase, luciferase, alkaline phosphatase); e) biotinylated groups; and f) predetermined polypeptide epitopes recognized by a secondary reporter (e.g., leucine zipper pair sequences, binding sites for secondary antibodies, metal binding domains, epitope tags, etc.). In some embodiments, the labeling group is coupled to the antigen binding protein via spacer arms of various lengths to reduce potential steric hindrance. Various methods for labeling proteins are known in the art.

Specific labels include optical dyes, including, but not limited to, chromophores, phosphors and fluorophores, with the latter being specific in many instances. Fluorophores can be either "small molecule" fluores, or proteinaceous fluores.

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in Molecular Probes Handbook by Richard P. Haugland, hereby expressly incorporated by reference.

Suitable proteinaceous fluorescent labels also include, but are not limited to, green fluorescent protein, including a *Renilla, Ptilosarcus*, or *Aequorea* species of GFP (Chalfie et al., 1994, *Science* 263:802-805), EGFP (Clontech Labs., Inc., Genbank Accession Number U55762), blue fluorescent protein (BFP, Quantum Biotechnologies, Inc., Quebec, Canada; Stauber, 1998, *Biotechniques* 24:462-471; Heim et al., 1996, *Curr. Biol.* 6:178-182), enhanced yellow fluorescent protein (EYFP, Clontech Labs., Inc.), luciferase (Ichiki et al., 1993, *J. Immunol.* 150:5408-5417), β galactosidase (Nolan et al., 1988, *Proc. Natl. Acad. Sci. U.S.A.* 85:2603-2607) and *Renilla* (WO92/15673, WO95/07463, WO98/14605, WO98/26277, WO99/49019, U.S. Pat. Nos. 5,292,658, 5,418,155, 5,683,888, 5,741,668, 5,777,079, 5,804,387, 5,874,304, 5,876,995, 5,925,558).

Nucleic acids that encode for the antigen binding proteins described herein, or portions thereof, are also provided, including nucleic acids encoding one or both chains of an antibody, or a fragment, derivative, mutein, or variant thereof, polynucleotides encoding heavy chain variable regions or only CDRs, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids). Any variable region provided herein may be attached to these constant regions to form complete heavy and light chain sequences. However, it should be understood that these constant regions sequences are provided as specific examples only. In some embodiments, the variable region sequences are joined to other constant region sequences that are known in the art.

Nucleic acids encoding certain antigen binding proteins, or portions thereof (e.g., full length antibody, heavy or light chain, variable domain, or CDRH1, CDRH2, CDRH3, CDRL1, CDRL2, or CDRL3) may be isolated from B-cells of mice that have been immunized with GIPR or an immunogenic fragment thereof. The nucleic acid may be isolated by conventional procedures such as polymerase chain reaction (PCR). Phage display is another example of a known technique whereby derivatives of antibodies and other antigen binding proteins may be prepared. In one approach, polypeptides that are components of an antigen binding protein of interest are expressed in any suitable recombinant expression system, and the expressed polypeptides are allowed to assemble to form antigen binding proteins.

An aspect further provides nucleic acids that hybridize to other nucleic acids under particular hybridization conditions. Methods for hybridizing nucleic acids are well-known in the art. See, e.g., Current Protocols in Molecular Biology, John Wiley & Sons, N.Y. (1989), 6.3.1-6.3.6. As defined herein, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65%, 70%, 75%, 80%, 85%, 90%, 95%, 98% or 99% identical to each other typically remain hybridized to each other.

The basic parameters affecting the choice of hybridization conditions and guidance for devising suitable conditions are set forth by, for example, Sambrook, Fritsch, and Maniatis (2001, Molecular Cloning: A Laboratory Manual, Cold Spring Harbor Laboratory Press, Cold Spring Harbor, N.Y., supra; and Current Protocols in Molecular Biology, 1995, Ausubel et al., eds., John Wiley & Sons, Inc., sections 2.10 and 6.3-6.4), and can be readily determined by those having ordinary skill in the art based on, e.g., the length and/or base composition of the nucleic acid.

Changes can be introduced by mutation into a nucleic acid, thereby leading to changes in the amino acid sequence of a polypeptide (e.g., an antibody or antibody derivative) that it encodes. Mutations can be introduced using any technique known in the art. In one embodiment, one or more particular amino acid residues are changed using, for example, a site-directed mutagenesis protocol. In another embodiment, one or more randomly selected residues is changed using, for example, a random mutagenesis protocol. However it is made, a mutant polypeptide can be expressed and screened for a desired property.

Mutations can be introduced into a nucleic acid without significantly altering the biological activity of a polypeptide that it encodes. For example, one can make nucleotide substitutions leading to amino acid substitutions at non-essential amino acid residues. Alternatively, one or more mutations can be introduced into a nucleic acid that selectively changes the biological activity of a polypeptide that it encodes. For example, the mutation can quantitatively or qualitatively change the biological activity. Examples of quantitative changes include increasing, reducing or eliminating the activity. Examples of qualitative changes include changing the antigen specificity of an antibody. In one embodiment, a nucleic acid encoding any antigen binding protein described herein can be mutated to alter the amino acid sequence using molecular biology techniques that are well-established in the art.

Another aspect provides nucleic acid molecules that are suitable for use as primers or hybridization probes for the detection of nucleic acid sequences. A nucleic acid molecule can comprise only a portion of a nucleic acid sequence encoding a full-length polypeptide, for example, a fragment that can be used as a probe or primer or a fragment encoding an active portion of a polypeptide.

Probes based on the sequence of a nucleic acid can be used to detect the nucleic acid or similar nucleic acids, for example, transcripts encoding a polypeptide. The probe can comprise a label group, e.g., a radioisotope, a fluorescent compound, an enzyme, or an enzyme co-factor. Such probes can be used to identify a cell that expresses the polypeptide.

Another aspect provides vectors comprising a nucleic acid encoding a polypeptide or a portion thereof (e.g., a fragment containing one or more CDRs or one or more variable region domains). Examples of vectors include, but are not limited to, plasmids, viral vectors, non-episomal mammalian vectors and expression vectors, for example, recombinant expression vectors. The recombinant expression vectors can comprise a nucleic acid in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see, Voss et al., 1986, *Trends Biochem. Sci.* 11:287, Maniatis et al., 1987, *Science* 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems (see, id.). It will be appreciated by those skilled in the art that the design of the expression vector can depend on such factors as the choice of the host cell to be transformed, the level of expression of protein desired, etc. The expression vectors can be introduced into host cells to thereby produce proteins or peptides, including fusion proteins or peptides, encoded by nucleic acids as described herein.

Another aspect provides host cells into which a recombinant expression vector has been introduced. A host cell can be any prokaryotic cell (for example, *E. coli*) or eukaryotic cell (for example, yeast, insect, or mammalian cells (e.g., CHO cells)). Vector DNA can be introduced into prokaryotic or eukaryotic cells via conventional transformation or transfection techniques. For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

Expression systems and constructs in the form of plasmids, expression vectors, transcription or expression cassettes that comprise at least one polynucleotide as described above are also provided herein, as well host cells comprising such expression systems or constructs.

The antigen binding proteins provided herein may be prepared by any of a number of conventional techniques. For example, GIPR antigen binding proteins may be produced by recombinant expression systems, using any technique known in the art. See, e.g., Monoclonal Antibodies, Hybridomas: A New Dimension in Biological Analyses, Kennet et al. (eds.) Plenum Press, New York (1980); and Antibodies: A Laboratory Manual, Harlow and Lane (eds.), Cold Spring Harbor Laboratory Press, Cold Spring Harbor, N.Y. (1988).

Antigen binding proteins can be expressed in hybridoma cell lines (e.g., in particular antibodies may be expressed in hybridomas) or in cell lines other than hybridomas. Expression constructs encoding the antibodies can be used to transform a mammalian, insect or microbial host cell. Transformation can be performed using any known method for introducing polynucleotides into a host cell, including, for example packaging the polynucleotide in a virus or bacteriophage and transducing a host cell with the construct by transfection procedures known in the art, as exemplified by U.S. Pat. Nos. 4,399,216; 4,912,040; 4,740,461; 4,959,455. The optimal transformation procedure used will depend upon which type of host cell is being transformed. Methods for introduction of heterologous polynucleotides into mammalian cells are well known in the art and include, but are not limited to, dextran-mediated transfection, calcium phosphate precipitation, polybrene mediated transfection, protoplast fusion, electroporation, encapsulation of the polynucleotide(s) in liposomes, mixing nucleic acid with positively-charged lipids, and direct microinjection of the DNA into nuclei.

Recombinant expression constructs typically comprise a nucleic acid molecule encoding a polypeptide comprising one or more of the following: one or more CDRs provided herein; a light chain constant region; a light chain variable region; a heavy chain constant region (e.g., $C_H1$, $C_H2$ and/or $C_H3$); and/or another scaffold portion of a GIPR antigen binding protein. These nucleic acid sequences are inserted into an appropriate expression vector using standard ligation techniques. In one embodiment, the heavy or light chain constant region is appended to the C-terminus of the anti-GIPR specific heavy or light chain variable region and is ligated into an expression vector. The vector is typically selected to be functional in the particular host cell employed (i.e., the vector is compatible with the host cell machinery, permitting amplification and/or expression of the gene can occur). In some embodiments, vectors are used that employ protein-fragment complementation assays using protein reporters, such as dihydrofolate reductase (see, for example, U.S. Pat. No. 6,270,964, which is hereby incorporated by reference). Suitable expression vectors can be purchased, for example, from Invitrogen Life Technologies or BD Biosciences (formerly "Clontech"). Other useful vectors for cloning and expressing the antibodies and fragments include those described in Bianchi and McGrew, 2003, *Biotech. Biotechnol. Bioeng.* 84:439-44, which is hereby incorporated by reference. Additional suitable expression vectors are discussed, for example, in *Methods Enzymol.*, vol. 185 (D. V. Goeddel, ed.), 1990, New York: Academic Press.

Typically, expression vectors used in any of the host cells will contain sequences for plasmid maintenance and for cloning and expression of exogenous nucleotide sequences. Such sequences, collectively referred to as "flanking sequences" in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector may contain a "tag"-encoding sequence, i.e., an oligonucleotide molecule located at the 5' or 3' end of the GIPR antigen binding protein coding sequence; the oligonucleotide sequence encodes polyHis (such as hexaHis), or another "tag" such as FLAG®, HA (hemaglutinin influenza virus), or myc, for which commercially available antibodies exist. This tag is typically fused to the polypeptide upon expression of the polypeptide, and can serve as a means for affinity purification or detection of the GIPR antigen binding protein from the host cell. Affinity purification can be accomplished, for example, by column chromatography using antibodies against the tag as an affinity matrix. Optionally, the tag can subsequently be removed from the purified GIPR antigen binding protein by various means such as using certain peptidases for cleavage.

Flanking sequences may be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence may be any prokaryotic or eukaryotic organism, any vertebrate or invertebrate organism, or any plant, provided that the flanking sequence is functional in, and can be activated by, the host cell machinery.

Flanking sequences useful in the vectors may be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence may be known. Here, the flanking sequence may be synthesized using the methods described herein for nucleic acid synthesis or cloning.

Whether all or only a portion of the flanking sequence is known, it may be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence may be isolated from a larger piece of DNA that may contain, for example, a coding sequence or even another gene or genes. Isolation may be accomplished by restriction endonuclease digestion to produce the proper DNA fragment followed by isolation using agarose gel purification, Qiagen® column chromatography (Chatsworth, Calif.), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one may be chemically synthesized based on a known sequence, and ligated into the vector. For example, the origin of replication from the plasmid pBR322 (New England Biolabs, Beverly, Mass.) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using methods for nucleic acid synthesis such as those described herein.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene may also be used for selection in both prokaryotic and eukaryotic host cells.

Other selectable genes may be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thymidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as an antigen binding protein that binds GIPR polypeptide. As a result, increased quantities of a polypeptide such as an antigen binding protein are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed.

In some cases, such as where glycosylation is desired in a eukaryotic host cell expression system, one may manipulate the various pre- or pro-sequences to improve glycosylation or yield. For example, one may alter the peptidase cleavage site of a particular signal peptide, or add prosequences, which also may affect glycosylation. The final protein product may have, in the −1 position (relative to the first amino acid of the mature protein), one or more additional amino acids incident to expression, which may not have been totally removed. For example, the final protein product may have one or two amino acid residues found in the peptidase cleavage site, attached to the amino-terminus. Alternatively, use of some enzyme cleavage sites may result in a slightly truncated form of the desired polypeptide, if the enzyme cuts at such area within the mature polypeptide.

Expression and cloning will typically contain a promoter that is recognized by the host organism and operably linked to the molecule encoding the GIPR antigen binding protein. Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe a gene to which they are operably linked, that is, with little or no control over gene expression. A large number of promoters, recognized by a variety of potential host cells, are well known. A suitable promoter is operably linked to the DNA encoding heavy chain or light chain comprising a GIPR antigen binding protein by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus, and Simian Virus 40 (SV40). Other suitable mammalian promoters include heterologous mammalian promoters, for example, heat-shock promoters and the actin promoter.

An enhancer sequence may be inserted into the vector to increase transcription of DNA encoding light chain or heavy chain comprising a GIPR antigen binding protein by higher eukaryotes. Enhancers are cis-acting elements of DNA, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer may be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides that are functional in mammalian host cells include the following: the signal sequence for interleukin-7 (IL-7) described in U.S. Pat. No. 4,965,195; the signal sequence for interleukin-2 receptor described in Cosman et al., 1984, *Nature* 312:768; the interleukin-4 receptor signal peptide described in EP Patent No. 0367 566; the type I interleukin-1 receptor signal peptide described in U.S. Pat. No. 4,968,607; the type II interleukin-1 receptor signal peptide described in EP Patent No. 0 460 846.

In one embodiment the leader sequence comprises SEQ ID NO: 3157 (MDMRVPAQLL GLLLLWLRGA RC) which is encoded by SEQ ID NO: 3158 (atggacatga gagtgcctgc acagctgctg ggcctgctgc tgctgtggct gagaggcgcc agatgc). In another embodiment the leader sequence comprises SEQ ID NO: 3159 (MAWALLLLTL LTQGTGSWA) which is encoded by SEQ ID NO: 3160 (atggcctggg ctctgctgct cctcacccctc ctcactcagg gcacagggtc ctgggcc).

The expression vectors that are provided may be constructed from a starting vector such as a commercially available vector. Such vectors may or may not contain all of the desired flanking sequences. Where one or more of the flanking sequences described herein are not already present in the vector, they may be individually obtained and ligated into the vector. Methods used for obtaining each of the flanking sequences are well known to one skilled in the art.

After the vector has been constructed and a nucleic acid molecule encoding light chain, a heavy chain, or a light chain and a heavy chain comprising a GIPR antigen binding sequence has been inserted into the proper site of the vector, the completed vector may be inserted into a suitable host cell for amplification and/or polypeptide expression. The transformation of an expression vector for an antigen-binding protein into a selected host cell may be accomplished by well-known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., 2001, supra.

A host cell, when cultured under appropriate conditions, synthesizes an antigen binding protein that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule.

Mammalian cell lines available as hosts for expression are well known in the art and include, but are not limited to, immortalized cell lines available from the American Type Culture Collection (ATCC), including but not limited to Chinese hamster ovary (CHO) cells, HeLa cells, baby hamster kidney (BHK) cells, monkey kidney cells (COS), human hepatocellular carcinoma cells (e.g., Hep G2), and a number of other cell lines. In certain embodiments, cell lines may be selected through determining which cell lines have high expression levels and constitutively produce antigen binding proteins with GIPR binding properties. In another embodiment, a cell line from the B cell lineage that does not make its own antibody but has a capacity to make and secrete a heterologous antibody can be selected.

In one embodiment, the present invention is directed to an antigen binding protein produced by a cell expressing one or more of the polynucleotides identified in Tables 2, 3, 4, and 5.

In one aspect, a GIPR binding protein is administered for chronic treatment. In another aspect, the binding proteins are administered for acute therapy.

Pharmaceutical compositions that comprise a GIPR antigen binding protein are also provided and can be utilized in any of the preventive and therapeutic methods disclosed herein. In an embodiment, a therapeutically effective amount of one or a plurality of the antigen binding proteins and a pharmaceutically acceptable diluent, carrier, solubilizer, emulsifier, preservative, and/or adjuvant are also provided. Acceptable formulation materials are nontoxic to recipients at the dosages and concentrations employed.

In certain embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-betacyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. REMINGTON'S PHARMACEUTICAL SCIENCES, 18" Edition, (A. R. Genrmo, ed.), 1990, Mack Publishing Company provides additional details and options for suitable agents that can be incorporated into the pharmaceutical compositions.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antigen binding proteins disclosed. In certain embodiments, the primary vehicle or carrier in a pharmaceutical composition may be either aqueous or non-aqueous in nature. For example, a suitable vehicle or carrier may be water for injection or physiological saline solution. In certain embodiments, GIPR antigen binding protein compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the GIPR antigen binding protein may be formulated as a lyophilizate using appropriate excipients such as sucrose.

The pharmaceutical compositions can be selected for parenteral delivery. Alternatively, the compositions may be selected for inhalation or for delivery through the digestive tract, such as orally. Preparation of such pharmaceutically acceptable compositions is within the skill of the art.

The formulation components are present preferably in concentrations that are acceptable to the site of administration. In certain embodiments, buffers are used to maintain the composition at physiological pH or at a slightly lower pH, typically within a pH range of from about 5 to about 8.

When parenteral administration is contemplated, the therapeutic compositions may be provided in the form of a pyrogen-free, parenterally acceptable aqueous solution comprising the desired human GIPR antigen binding protein in a pharmaceutically acceptable vehicle. A particularly suitable vehicle for parenteral injection is sterile distilled water in which the GIPR antigen binding protein is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antigen binding protein.

Certain pharmaceutical compositions are formulated for inhalation. In some embodiments, GIPR antigen binding proteins are formulated as a dry, inhalable powder. In specific embodiments, GIPR antigen binding protein inhalation solutions may also be formulated with a propellant for aerosol delivery. In certain embodiments, solutions may be nebulized. Pulmonary administration and formulation methods therefore are further described in International Patent Application No. PCT/US94/001875, which is incorporated by reference and describes pulmonary delivery of chemically modified proteins. Some formulations can be administered orally. GIPR antigen binding proteins that are administered in this fashion can be formulated with or without carriers customarily used in the compounding of solid dosage forms such as tablets and capsules. In certain embodiments, a capsule may be designed to release the active portion of the formulation at the point in the gastrointestinal tract when bioavailability is maximized and pre-systemic degradation is minimized. Additional agents can be included to facilitate absorption of the GIPR antigen binding protein. Diluents, flavorings, low melting point waxes, vegetable oils, lubricants, suspending agents, tablet disintegrating agents, and binders may also be employed.

Some pharmaceutical compositions comprise an effective quantity of one or a plurality of GIPR antigen binding proteins in a mixture with non-toxic excipients that are suitable for the manufacture of tablets. By dissolving the tablets in sterile water, or another appropriate vehicle, solutions may be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions will be evident to those skilled in the art, including formulations involving GIPR binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481, each of which is incorporated by reference), copolymers of L-glutamic acid and gamma ethyl-L-glutamate (Sidman et al., 1983, *Biopolymers* 2:547-556), poly (2-hydroxyethyl-inethacrylate) (Langer et al., 1981, *J. Biomed. Mater. Res.* 15:167-277 and Langer, 1982, *Chem. Tech.* 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, *Proc. Natl. Acad. Sci. U.S.A.* 82:3688-3692; European Patent Application Publication Nos. EP 036,676; EP 088,046 and EP 143,949, incorporated by reference.

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

In certain formulations, an antigen binding protein has a concentration of at least 10 mg/mL, 20 mg/mL, 30 mg/mL, 40 mg/mL, 50 mg/mL, 60 mg/mL, 70 mg/mL, 80 mg/mL, 90 mg/mL, 100 mg/mL or 150 mg/mL. In one embodiment, a pharmaceutical composition comprises the antigen binding protein, a buffer and polysorbate. In other embodiments, the pharmaceutical composition comprises an antigen binding protein, a buffer, sucrose and polysorbate. An example of a pharmaceutical composition is one containing 50-100 mg/mL of antigen binding protein, 5-20 mM sodium acetate, 5-10% w/v sucrose, and 0.002-0.008% w/v polysorbate. Certain, compositions, for instance, contain 65-75 mg/mL of an antigen binding protein in 9-11 mM sodium acetate buffer, 8-10% w/v sucrose, and 0.005-0.006% w/v polysorbate. The pH of certain such formulations is in the range of 4.5-6. Other formulations have a pH of 5.0-5.5 (e.g., pH of 5.0, 5.2 or 5.4).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. Kits for producing a single-dose administration unit are also provided. Certain kits contain a first container having a dried protein and a second container having an aqueous formulation. In certain embodiments, kits containing single and multi-chambered pre-filled syringes (e.g., liquid syringes and lyosyringes) are provided. The therapeutically effective amount of a GIPR antigen binding protein-containing pharmaceutical composition to be employed will depend, for example, upon the therapeutic context and objectives. One skilled in the art will appreciate that the appropriate dosage levels for treatment will vary depending, in part, upon the molecule delivered, the indication for which the GIPR antigen binding protein is being used, the route of administration, and the size (body weight, body surface or organ size) and/or condition (the age and general health) of the patient. In certain embodiments, the clinician may titer the dosage and modify the route of administration to obtain the optimal therapeutic effect.

Dosing frequency will depend upon the pharmacokinetic parameters of the particular GIPR antigen binding protein in the formulation used. Typically, a clinician administers the composition until a dosage is reached that achieves the desired effect. The composition may therefore be administered as a single dose, or as two or more doses (which may or may not contain the same amount of the desired molecule) over time, or as a continuous infusion via an implantation device or catheter. Appropriate dosages may be ascertained through use of appropriate dose-response data. In certain embodiments, the antigen binding proteins can be administered to patients throughout an extended time period. In certain embodiments, the antigen binding protein is dosed every two weeks, every month, every two months, every three months, every four months, every five months, or every six months.

The route of administration of the pharmaceutical composition is in accord with known methods, e.g., orally, through injection by intravenous, intraperitoneal, intracerebral (intra-parenchymal), intracerebroventricular, intramuscular, intra-ocular, intraarterial, intraportal, or intralesional routes; by sustained release systems or by implantation devices. In certain embodiments, the compositions may be administered by bolus injection or continuously by infusion, or by implantation device.

The composition also may be administered locally via implantation of a membrane, sponge or another appropriate material onto which the desired molecule has been absorbed or encapsulated. In certain embodiments, where an implantation device is used, the device may be implanted into any suitable tissue or organ, and delivery of the desired molecule may be via diffusion, timed-release bolus, or continuous administration.

It also may be desirable to use GIPR antigen binding protein pharmaceutical compositions according to the disclosed ex vivo. In such instances, cells, tissues or organs that have been removed from the patient are exposed to GIPR antigen binding protein pharmaceutical compositions after which the cells, tissues and/or organs are subsequently implanted back into the patient.

A physician will be able to select an appropriate treatment indication and target lipid levels depending on the individual profile of a particular patient. One well-accepted standard for guiding treatment of hyperlipidemia is the Third Report of the National Cholesterol Education Program (NCEP) Expert Panel on Detection, Evaluation, and Treatment of the High Blood Cholesterol in Adults (Adult Treatment Panel III) Final Report, National Institutes of Health, NIH Publication No. 02-5215 (2002), the printed publication of which is hereby incorporated by reference in its entirety.

The efficacy of a particular dose can be assessed by reference to biomarkers or improvement in certain physiological parameters. Examples of suitable biomarkers include, the ratio of free cholesterol to plasma lipid, free cholesterol to membrane protein, phospatidylcholine to sphingomyelin, or HDL-C levels.

Also provided herein are compositions comprising a GIPR antigen binding protein and one or more additional therapeutic agents, as well as methods in which such agents are administered concurrently or sequentially with a GIPR antigen binding protein for use in the preventive and therapeutic methods disclosed herein. The one or more additional agents can be co-formulated with a GIPR antigen binding protein or can be co-administered with a GIPR antigen binding protein. In general, the therapeutic methods, compositions and compounds may also be employed in combination with other therapeutics in the treatment of various disease states, with the additional agents being administered concurrently.

In one aspect the present invention is directed to a method of treating a subject with a metabolic disorder, the method comprising administering to the subject a therapeutically effective amount of a GLP-1 receptor agonist and a therapeutically effective amount of a GIPR antagonist that specifically binds to a protein having an amino acid sequence having at least 90% amino acid sequence identity to an amino acid sequence of a GIPR.

A "GLP-1 receptor agonist" refers to compounds having GLP-1 receptor activity. Such exemplary compounds include exendins, exendin analogs, exendin agonists, GLP-1(7-37), GLP-1(7-37) analogs, GLP-1(7-37) agonists, and the like. The GLP-1 receptor agonist compounds may optionally be amidated. The terms "GLP-1 receptor agonist" and "GLP-1 receptor agonist compound" have the same meaning.

The term "exendin" includes naturally occurring (or synthetic versions of naturally occurring) exendin peptides that are found in the salivary secretions of the Gila monster. Exendins of particular interest include exendin-3 and exendin-4. The exendins, exendin analogs, and exendin agonists for use in the methods described herein may optionally be amidated, and may also be in an acid form, pharmaceutically acceptable salt form, or any other physiologically active form of the molecule.

In one embodiment, the molar ratio of a GLP-1 receptor agonist to a GIPR antagonist is from about 1:1 to 1:110, 1:1 to 1:100, 1:1 to 1:75, 1:1 to 1:50, 1:1 to 1:25, 1:1 to 1:10, 1:1 to 1:5, and 1:1. In one embodiment, the molar ratio of a GIPR antagonist to a GLP-1 receptor agonist is from about 1:1 to 1:110, 1:1 to 1:100, 1:1 to 1:75, 1:1 to 1:50, 1:1 to 1:25, 1:1 to 1:10, and 1:1 to 1:5.

In one embodiment, the GLP-1 receptor agonist is used in combination with the GIPR antagonist at therapeutically effective molar ratios of between about 1:1.5 to 1:150, preferably 1:2 to 1:50.

In one embodiment, the GLP-1 receptor agonist and the GIPR antagonist are present in doses that are at least about 1.1 to 1.4, 1.5, 2, 3, 4, 5, 6, 7, 8, 9, or 10 fold lower than the doses of each compound alone required to treat a condition and/or disease.

In one embodiment, the GLP-1 receptor agonist is GLP-1(7-37) or a GLP-1(7-37) analog.

In one embodiment, the GLP-1 receptor agonist is selected from the group consisting of exenatide, liraglutide, lixisenatide, albiglutide, dulaglutide, semaglutide, and taspoglutide.

In one aspect the present invention is directed to a method of treatment comprising administering to a subject a therapeutically effective amount of at least one GLP-1 receptor agonist in combination with administration of at least one GIPR antagonist which upon administration to a subject with symptoms of a metabolic disorder provides sustained beneficial effects.

In one embodiment, administration of at least one GLP-1 receptor agonist in combination with administration of at least one GIPR antagonist provides sustained beneficial effects of at least one symptom of a metabolic disorder.

In one embodiment, the therapeutically effective amounts of the GLP-1 receptor agonist and the GIPR antagonist are combined prior to administration to the subject.

In one embodiment, the therapeutically effective amounts of the GLP-1 receptor agonist and the GIPR antagonist are administered to the subject sequentially.

In one embodiment, the therapeutically effective amounts of a GLP-1 receptor agonist and a GIPR antagonist are synergistically effective amounts.

Exendin-4 (HGEGTFTSDLSKQMEEEAVRLFIEWLKNGGPSSGAPPPS-NH$_2$ (SEQ ID NO: 3163)) is a peptide found in the saliva of the Gila monster, *Heloderma suspectum*; and exendin-3 (HSDGTFTSDLSKQMEEEAVRLFIEWLKNGGPSSGAPPPS-NH$_2$(SEQ ID NO: 3164)) is a peptide found in the saliva of the beaded lizard, *Heloderma horridum*. Exendins have some amino acid sequence similarity to some members of the glucagon-like peptide (GLP) family. For example, exendin-4 has about 53% sequence identity with glucagon-like peptide-1(GLP-1)(7-37) (HAE-GTFTSDVSSYLEGQAAKEFIAWLVKGRG (SEQ ID NO: 3184)). However, exendin-4 is transcribed from a distinct gene, not the Gila monster homolog of the mammalian proglucagon gene from which GLP-1 is expressed. Additionally, exendin-4 is not an analog of GLP-1(7-37) because the structure of synthetic exendin-4 peptide was not created by sequential modification of the structure of GLP-1. Nielsen et al., *Current Opinion in Investigational Drugs*, 4(4):401-405 (2003).

Synthetic exendin-4, also known as exenatide, is commercially available as BYETTA® (Amylin Pharmaceuticals, Inc. and Eli Lilly and Company). A once weekly formulation of exenatide is described in WO 2005/102293, the disclosure of which is incorporated by reference herein.

"Exendin analog" refers to peptides which elicit a biological activity of an exendin reference peptide, preferably having a potency equal to or better than the exendin reference peptide (e.g., exendin-4), or within five orders of magnitude (plus or minus) of potency compared to the exendin reference peptide, when evaluated by art-known measures such as receptor binding and/or competition studies as described, e.g., by Hargrove et al., *Regulatory Peptides*, 141:113-119 (2007), the disclosure of which is incorporated by reference herein. Preferably, the exendin analogs will bind in such assays with an affinity of less than 1 µM, and more preferably with an affinity of less than 3 nM, less than 1 nM, or less than 0.1 nM. The term "exendin analog" may also be referred to as "exendin agonist". In a preferred embodiment, the exendin analog is an exendin-4 analog.

Exendin analogs also include the peptides described herein which have been chemically derivatized or altered, for example, peptides with non-natural amino acid residues (e.g., taurine, β-amino acid residues, γ-amino acid residues, and D-amino acid residues), C-terminal functional group modifications, such as amides, esters, and C-terminal ketone modifications and N-terminal functional group modifications, such as acylated amines, Schiff bases, or cyclization, as found, for example, in the amino acid pyroglutamic acid. Exendin analogs may also contain other chemical moieties, such as peptide mimetics.

Exemplary exendins and exendin analogs exendin-4 (SEQ ID NO: 3163); exendin-3 (SEQ ID NO: 3164); Leu$^{14}$-exendin-4 (SEQ ID NO: 3165); Leu$^{14}$,Phe$^{25}$-exendin-4 (SEQ ID NO: 3166); Leu$^{14}$,Ala$^{19}$,Phe$^{25}$-exendin-4 (SEQ ID NO: 3167); exendin-4(1-30) (SEQ ID NO: 3168); Leu$^{14}$-exendin-4(1-30) (SEQ ID NO: 3169); Leu$^{14}$,Phe$^{25}$-exendin-4(1-30) (SEQ ID NO: 3170); Leu$^{14}$,Ala$^{19}$,Phe$^{25}$-exendin-4(1-30) (SEQ ID NO: 3171); exendin-4(1-28) (SEQ ID NO: 3172); Leu$^{14}$-exendin-4(1-28) (SEQ ID NO: 3173); Leu$^{14}$,Phe$^{25}$-exendin-4(1-28) (SEQ ID NO: 3174); Leu$^{14}$,Ala$^{19}$,Phe$^{25}$-exendin-4 (1-28) (SEQ ID NO: 3175); Leu$^{14}$,Lys$^{17,20}$,Ala$^{19}$,Glu$^{21}$,Phe$^{25}$,Gln$^{2}$-exendin-4 (SEQ ID NO: 3176); Leu$^{14}$,Lys$^{17,20}$,Ala$^{19}$,Glu$^{25}$,Gln$^{28}$-exendin-4 (SEQ ID NO: 3177); octylGly$^{14}$,Gln$^{28}$-exendin-4 (SEQ ID NO: 3178); Leu$^{14}$,Gln$^{28}$,octylGly$^{34}$-exendin-4 (SEQ ID NO: 3179); Phe$^{4}$,Leu$^{14}$,Gln$^{28}$,Lys$^{33}$,Glu$^{34}$, Ile$^{35,36}$,Ser$^{37}$-exendin-4(1-37) (SEQ ID NO: 3180); Phe$^{4}$,Leu$^{14}$,Lys$^{17,20}$, Ala$^{19}$,Glu$^{21}$, Gln$^{28}$-exendin-4 (SEQ ID NO: 3181); Val$^{11}$, Ile$^{13}$,Leu$^{14}$,Ala$^{16}$,Lys$^{21}$,Phe$^{25}$-exendin-4 (SEQ ID NO: 3182); exendin-4-Lys$^{4}$ (SEQ ID NO: 3183); lixisenatide (Sanofi-Aventis/Zealand Pharma); CJC-1134 (ConjuChem. Inc.); [N$^{e}$-(17-carboxyheptadecanoic acid)Lys$^{20}$]exendin-4-NH$_2$ (SEQ ID NO: 3208); [N$^{e}$-(17-carboxyhepta-decanoyl) Lys$^{32}$]exendin-4-NH$_2$ (SEQ ID NO: 3209); [desamino-His$^{1}$, N$^{e}$-(17-carboxyheptadecanoyl)Lys$^{20}$]exendin-4-NH$_2$ (SEQ ID NO: 3210); [Arg$^{12,27}$,NLe$^{14}$,N$^{e}$-(17-carboxy-heptadecanoyl)Lys$^{32}$]exendin-4-NH$_2$ (SEQ ID NO: 3211); [N$^{e}$-(19- carboxy-nonadecanoylamino)Lys$^{32}$]-exendin-4-NH$_2$ (SEQ ID NO: 3212); [N$^\varepsilon$-(15-carboxypentadecanoylamino) Lys$^{20}$]-exendin-4-NH$_2$(SEQ ID NO: 3213); [N$^\varepsilon$-(13-carboxytridecanoylamino)Lys$^{20}$]exendin-4-NH$_2$ (SEQ ID NO: 3214); [N$^\varepsilon$-(11-carboxy-undecanoyl-amino)Lys$^{20}$]exendin-4-NH$_2$ (SEQ ID NO: 3215); exendin-4-Lys$^{40}$(e-MPA)-NH$_2$ (SEQ ID NO: 3216); exendin-4-Lys$^{40}$(e-AEEA-AEEA-MPA)-NH$_2$ (SEQ ID NO: 3217); exendin-4-Lys$^{40}$(e-AEEA-MPA)-NH$_2$ (SEQ ID NO: 3218); exendin-4-Lys$^{40}$(e-MPA)-albumin (SEQ ID NO: 3219); exendin-4-Lys$^{40}$(e-AEEA-AEEA-MPA)-albumin (SEQ ID NO: 3220); exendin-4-Lys$^{40}$(e-AEEA-MPA)-albumin (SEQ ID NO: 3221); and the like. AEEA refers to [2-(2-amino)ethoxy)]acetic acid. EDA refers to ethylenediamine. MPA refers to maleimidopropionic acid. The exendins and exendin analogs may optionally be amidated.

In one embodiment, the GLP-1 receptor agonist compound is an exendin-4 analog that has at least 80% sequence identity to exendin-4 (SEQ ID NO: 3163); at least 85% sequence identity to exendin-4 (SEQ ID NO: 3163); at least 90% sequence identity to exendin-4 (SEQ ID NO: 3163); or at least 95% sequence identity to exendin-4 (SEQ ID NO: 3163).

Other exendins and exendin analogs useful in the methods described herein include those described in WO 98/05351; WO 99/07404; WO 99/25727; WO 99/25728; WO 99/40788; WO 00/41546; WO 00/41548; WO 00/73331; WO 01/51078; WO 03/099314; U.S. Pat. Nos. 6,956,026; 6,506,724; 6,703,359; 6,858,576; 6,872,700; 6,902,744; 7,157,555; 7,223,725; 7,220,721; US Publication No. 2003/0036504; and US Publication No. 2006/0094652, the disclosures of which are incorporated by reference herein in their entirety.

"GLP-1(7-37) analogs" refers to peptides which elicit a biological activity similar to that of GLP-1(7-37), when evaluated by art-known measures such as receptor binding assays or in vivo blood glucose assays as described, e.g., by Hargrove et al., *Regulatory Peptides,* 141:113-119 (2007), the disclosure of which is incorporated by reference herein. In one embodiment, the term "GLP-1(7-37) analog" refers to a peptide that has an amino acid sequence with 1, 2, 3, 4, 5, 6, 7 or 8 amino acid substitutions, insertions, deletions, or a combination of two or more thereof, when compared to the amino acid sequence of GLP-1(7-37). In one embodiment, the GLP-1(7-37) analog is GLP-1(7-36)-NH$_2$. GLP-1(7-37) analogs include the amidated forms, the acid form, the pharmaceutically acceptable salt form, and any other physiologically active form of the molecule.

Exemplary GLP-1(7-37) and GLP-1(7-37) analogs include GLP-1(7-37) (SEQ ID NO: 3184); GLP-1(7-36)-NH$_2$ (SEQ ID NO: 3185); liraglutide (VICTOZA® from Novo Nordisk); albiglutide (SYNCRIA® from GlaxoSmithKline); taspoglutide (Hoffman La-Roche); dulaglutide (also known LY2189265; Eli Lilly and Company); LY2428757 (Eli Lilly and Company); desamino-His$^7$,Arg$^{26}$,Lys$^{34}$(N$^\varepsilon$-(γ-Glu(N-α-hexadecanoyl)))-GLP-1(7-37) (core peptide disclosed as SEQ ID NO: 3222); desamino-His$^7$,Arg$^{26}$,Lys$^{34}$(N$^\varepsilon$-octanoyl)-GLP-1(7-37) (SEQ ID NO: 3223); Arg$^{26,34}$, Lys$^{38}$(N$^\varepsilon$-(ω-carboxypentadecanoyl))-GLP-1(7-38) (SEQ ID NO: 3224); Arg$^{26,34}$,Lys$^{36}$N(N$^\varepsilon$(γ-Glu(N-α-hexadecanoyl)))-GLP-1(7-36) (core peptide disclosed as SEQ ID NO: 3225); Aib$^{8,35}$,Arg$^{26,34}$,Phe$^{31}$-GLP-1(7-36)) (SEQ ID NO: 3186); HXaa$_8$EGTFTSDVSSYLEXaa$_{22}$Xaa$_{23}$ AAKEFIXaa$_{30}$WLXaa$_{33}$Xaa$_{34}$G Xaa$_{36}$Xaa$_{37}$; wherein Xaa$_3$ is A, V, or G; Xaa$_{22}$ is G, K, or E; Xaa$_{23}$ is Q or K; Xaa$_{30}$ is A or E: Xaa$_{33}$ is V or K; Xaa$_{34}$ is K, N, or R; Xaa$_{36}$ is R or G; and Xaa$_{37}$ is G, H, P, or absent (SEQ ID NO: 3187); Arg$^{34}$-GLP-1(7-37) (SEQ ID NO: 3188); Glu$^{30}$-GLP-1(7-37) (SEQ ID NO: 3189); Lys$^{22}$-GLP-1(7-37) (SEQ ID NO: 3190); Gly$^{8,36}$,Glu$^{22}$-GLP-1(7-37) (SEQ ID NO: 3191); Val$^8$,Glu$^{22}$,Gly$^{36}$-GLP-1(7-37) (SEQ ID NO: 3192); Gly$^{8,36}$,Glu$^{22}$,Lys$^{33}$,Asn$^{34}$-GLP-1(7-37) (SEQ ID NO: 3193); Val$^8$,Glu$^{22}$,Lys$^{33}$,Asn$^{34}$,Gly$^{36}$-GLP-1(7-37) (SEQ ID NO: 3194); Gly$^{8,36}$,Glu$^{22}$,Pro$^{37}$-GLP-1(7-37) (SEQ ID NO: 3195); Val$^8$,Glu$^{22}$,Gly$^{36}$Pro$^{37}$-GLP-1(7-37) (SEQ ID NO: 3196); Gly$^{8,36}$,Glu$^{22}$,Lys$^{33}$,Asn$^{34}$,Pro$^{37}$-GLP-1(7-37) (SEQ ID NO: 3197); Val$^8$,Glu$^{22}$,Lys$^{33}$,Asn$^{34}$,Gly$^{36}$,Pro$^{37}$-GLP-1(7-37) (SEQ ID NO: 3198), Gly$^{8,36}$,Glu$^{22}$-GLP-1(7-36) (SEQ ID NO: 3199); Val$^8$,Glu$^{22}$,Gly$^{36}$-GLP-1(7-36) (SEQ ID NO: 3200); Val$^8$,Glu$^{22}$,Asn$^{34}$,Gly$^{36}$-GLP-1(7-36) (SEQ ID NO: 3201); Gly$^{8,36}$,Glu$^{22}$,Asn$^{34}$-GLP-1(7-36) (SEQ ID NO: 3202). Each of the GLP-1(7-37) and GLP-1(7-37) analogs may optionally be amidated.

In one embodiment; the GLP-1(7-37) or GLP-1(7-37) analogs are covalently linked (directly or by a linking group) to an Fe portion of an immunoglobulin IgG, IgE; IgG; and the like). For example, any one of SEQ ID NOs:25-40 may be covalently linked to the Fe portion of an immunoglobulin comprising the sequence of: AESKYGPPCPPCPAPX aa$_{16}$Xaa$_{17}$Xaa$_{18}$GGPSVFLFPPKPKDTLMISRTPEVTCV-VVDVSQ EDPEVQFNWYVDGVEVITNAKTKPRE-EQFX aa$_{80}$STYRVVSVLTVLFIQDWLNGKEYK CKVSN KGLPSSIEKTISKAKGQPREPQVYTLPPSQEEMTKN-QVSLTCLVKGFYPSDIA VEWESNGQPENNYKTTPPV-LDSDGSTFLYSRLTVDKSRWQEGNVESCSVMHEAL HN HYTQKSLSLSLGXaa$_{230}$; wherein Xaa$_{16}$ is P or E; Xaa$_{17}$ is F, V or A; Xaa$_{18}$ is L, E or A; Xaa$_{80}$ is N or A; and Xaa$_{230}$ is K or absent (SEQ ID NO: 3203). The linking group may be any chemical moiety (e.g., amino acids and/or chemical groups). In one embodiment, the linking group is (-GGGGS—)$_x$ (SEQ ID NO: 3204) where x is 1, 2, 3, 4, 5 or 6; preferably 2, 3 or 4; more preferably 3. In one embodiment, the GLP-1(7-37) analog covalently linked to the Fc portion of an immunoglobulin comprises the amino acid sequence:

(SEQ ID NO: 3205)
HGEGTFTSDVSSYLEEQAAKEFIAWLVKGGGGGGGSGGGGSGGGGSAES

KYGPPCPPCPAPEAAGGPSVFLFPPKPKDTLMISRTPEVTCVVVDVSQE

DPEVQFNWYVDGVEVHNAKTKPREEQFNSTYRVVSVLTVLHQDWLNGKE

YKCKVSNKGLPSSIEKTISKAKGQPREPQVYTLPPSQEEMTKNQVSLTC

LVKGFYPSDIAVEWESNGQPENNYKTTPPVLDSDGSFFLYSR LTVDKS

RWQEGNVFSCSVMHEALHNHYTQKSLSLSLG.

In another embodiment, the GLP-1(7-37) or GLP-1(7-37) analog may be covalently linked (directly or through a linking group) to one or two polyethylene glycol molecules. For example, a GLP-1(7-37) analog may comprise the amino acid sequence: HXaa$_8$EGTFTSDVS SYLEXaa$_{22}$ QAAKEFIAWLXaa$_{33}$KGGPSSGAPPPC$_{45}$C$_{46}$—Z, wherein Xaa$_8$ is: D-Ala, G, V, L, I, S or T; Xaa$_{22}$ is G, E, D or K; Xaa$_{33}$ is: V or I; and Z is OH or NH$_2$, (SEQ ID NO: 3206), and, optionally, wherein (i) one polyethylene glycol moiety is covalently attached to C$_{45}$, (ii) one polyethylene glycol moiety is covalently attached to C$_{46}$, or (iii) one polyethylene glycol moiety is attached to C$_{45}$ and one polyethylene glycol moiety is attached to C$_{46}$. In one embodiment, the GLP-1(7-37) analog is HVEGTFTSDVSSYLEEQAAKEFI AWLIKGGPSSGAPPPC$_{45}$C$_{46}$—NH$_2$ (SEQ ID NO: 3207) and, optionally, wherein (i) one polyethylene glycol moiety is covalently attached to C4, (ii) one polyethylene glycol moiety is covalently attached to $C_{46}$, or (iii) one polyethylene glycol moiety is attached to C45 and one polyethylene glycol moiety is attached to C46.

In one embodiment, the GLP-1 receptor agonist compound is a peptide that has at least 80% sequence identity to GLP-1(7-37) (SEQ ID NO: 3184); at least 85% sequence identity to GLP-1(7-37) (SEQ ID NO: 3184); at least 90% sequence identity to GLP-1(7-37) (SEQ ID NO: 3184); or at least 95% sequence identity to GLP-1(7-37) (SEQ ID NO: 3184).

GLP-1 receptor agonist compounds may be prepared by processes well known in the art, e.g., peptide purification as described in Eng et al., *J. Biol. Chem.*, 265:20259-62 (1990); standard solid-phase peptide synthesis techniques as described in Raufman et al., *J. Biol. Chem.*, 267:21432-37 (1992); recombinant DNA techniques as described in Sambrook et al., *Molecular Cloning: A Laboratory Manual*, 2d Ed., Cold Spring Harbor (1989); and the like.

TABLE 7

Examples of GLP-1 Agonist Sequences

| SEQ ID NO: | Sequence | Description |
| --- | --- | --- |
| 3163 | HGEGTFTSDLSKQMEEEAVRLFIEWLKNGGPSSGAPPPS | Exendin-4 |
| 3164 | HSDGTFTSDLSKQMEEEAVRLFIEWLKNGGPSSGAPPPS | Exendin-3 |
| 3165 | HGEGTFTSDLSKQLEEEAVRLFIEWLKNGGPSSGAPPPS | $Leu^{14}$-exendin-4 |
| 3166 | HGEGTFTSDLSKQLEEEAVRLFIEFLKNGGPSSGAPPPS | $Leu^{14}$, $Phe^{25}$-exendin-4 |
| 3167 | HGEGTFTSDLSKQLEEEAARLFIEFLKNGGPSSGAPPPS | $Leu^{14}$, $Ala^{19}$, $Phe^{25}$-exendin-4 |
| 3168 | HGEGTFTSDLSKQMEEEAVRLFIEWLKNGG | exendin-4(1-30) |
| 3169 | HGEGTFTSDLSKQLEEEAVRLFIEWLKNGG | $Leu^{14}$-exendin-4(1-30) |
| 3170 | HGEGTFTSDLSKQLEEEAVRLFIEFLKNGG | $Leu^{14}$, $Phe^{25}$-exendin-4(1-30) |
| 3171 | HGEGTFTSDLSKQLEEEAARLFIEFLKNGG | $Leu^{14}$, $Ala^{19}$, $Phe^{25}$-exendin-4(1-30) |
| 3172 | HGEGTFTSDLSKQMEEEAVRLFIEWLKN | exendin-4(1-28) |
| 3173 | HGEGTFTSDLSKQLEEEAVRLFIEWLKN | $Leu^{14}$-exendin-4(1-28) |
| 3174 | HGEGTFTSDLSKQLEEEAVRLFIEFLKN | $Leu^{14}$, $Phe^{25}$-exendin-4(1-28) |
| 3175 | HGEGTFTSDLSKQLEEEAARLFIEFLKN | $Leu^{14}$, $Ala^{19}$, $Phe^{25}$-exendin-4(1-28) |
| 3176 | HGEGTFTSDLSKQLEEKAAKEFIEFLKQGGPSSGAPPPS | $Leu^{14}$, $Lys^{17,\ 20}$, $Ala^{19}$, $Glu^{21}$, $Phe^{25}$, $Gln^{28}$-exendin-4 |
| 3177 | HGEGTFTSDLSKQLEEKAAKEFIEWLKQGGPSSGAPPPS | $Leu^{14}$, $Lys^{17,\ 20}$, $Ala^{19}$, $Glu^{21}$, $Gln^{28}$-exendin-4 |
| 3178 | HGEGTFTSDLSKQ(octylG)EEEAVRLFIEWLKQGGPSSGAPPPS | $octylGly^{14}$, $Gln^{28}$-exendin-4 |
| 3179 | HGEGTFTSDLSKQLEEEAVRLFIEWLKQGGPSS(octylG)APPPS | $Leu^{14}$, $Gln^{28}$, $octylGly^{34}$-exendin-4 |
| 3180 | HGEFTFTSDLSKQLEEEAVRLFIEWLKQGGPSKEIIS | $Phe^4$, $Leu^{14}$, $Gln^{28}$, $Lys^{33}$, $Glu^{34}$, $Ile^{35,\ 36}$, $Ser^{37}$-exendin-4(1-37) |
| 3181 | HGEFTFTSDLSKQLEEKAAKEFIEWLKQGGPSSGAPPPS | $Phe^4$, $Leu^{14}$, $Lys^{17,\ 20}$, $Ala^{19}$, $Glu^{12}$, $Gln^{28}$-exendin-4 |
| 3182 | HGEGTFTSDLVKILEAEAVRKFIEFLKNGGPSSGAPPPS | $Val^{11}$, $Ile^{13}$, $Lue^{14}$, $Ala^{16}$, $Lys^{21}$, $Phe^{25}$-exendin-4 |
| 3183 | HGEGTFTSDLSKQMEEEAVRLFIEWLKNGGPSSGAPPPSK | exedin-4-$Lys^{40}$ |
| 3184 | HAEGTFTSDVSSYLEGQAAKEFIAWLVKGRG | GLP-1(7-37) |

TABLE 7 -continued

Examples of GLP-1 Agonist Sequences

| SEQ ID NO: | Sequence | Description |
|---|---|---|
| 3185 | HAEGTFTSDVSSYLEGQAAKEFIAWLVKGR | GLP-1(7-36)-NH$_2$ |
| 3186 | H(Aib)EGTFTSDVSSYLEGQAAREFIAFLVR(Aib)R | Aib$^{8, 35}$, Arg$^{26, 34}$, Phe$^{31}$-GLP-1(7-36)) |
| 3187 | HXaa$_8$EGTFTSDVSSYLEXaa$_{22}$Xaa$_{23}$AAKEFIXaa$_{30}$WLXaa$_{33}$Xaa$_{34}$GXaa$_{36}$Xaa$_{37}$ wherein Xaa$_8$ is A, V, or G Xaa$_{22}$ is G, K, or E Xaa$_{23}$ is Q or K Xaa$_{30}$ is A or E Xaa$_{33}$ is V or K Xaa$_{34}$ is K, N, or R Xaa$_{36}$ is R or G and Xaa$_{37}$ is G, H, P, or absent | HXaa$_8$EGTFTSDVSSYLEXaa$_{22}$Xaa$_{23}$AAKEFIXaa$_{30}$WLXaa$_{33}$Xaa$_{34}$G Xaa$_{36}$Xaa$_{37}$ wherein Xaa$_8$ is A, V, G Xaa$_{22}$ is G, K, or E Xaa$_{23}$ is Q or K Xaa$_{30}$ is A or E Xaa$_{33}$ is V or K Xaa$_{34}$ is K, N, or R Xaa$_{36}$ is R or G and Xaa$_{37}$ is G, H, P, or absent |
| 3188 | HAEGTFTSDVSSYLEGQAAKEFIAWLVRGRG | Arg$^{34}$-GLP-1(7-37) |
| 3189 | HAEGTFTSDVSSYLEGQAAKEFIEWLVKGRG | Glu$^{30}$-GLP-1(7-37) |
| 3190 | HAEGTFTSDVSSYLEKQAAKEFIAWLVKGRG | Lys$^{22}$-GLP-1(7-37) |
| 3191 | HGEGTFTSDVSSYLEEQAAKEFIAWLVKGGG | Gly$^{8, 36}$, Glu$^{22}$-GLP-1(7-37) |
| 3192 | HVEGTFTSDVSSYLEEQAAKEFIAWLVKGGG | Val$^8$, Glu$^{22}$, Gly$^{36}$-GLP-1(7-37) |
| 3193 | HGEGTFTSDVSSYLEEQAAKEFIAWLKNGGG | Gly$^{8, 36}$, Glu$^{22}$, Lys$^{33}$, Asn$^{34}$-GLP-1(7-37) |
| 3194 | HVEGTFTSDVSSYLEEQAAKEFIAWLKNGGG | Val$^8$, Glu$^{22}$, Lys$^{33}$, Asn$^{34}$, Gly$^{36}$-GLP-1(7-37) |
| 3195 | HGEGTFTSDVSSYLEEQAAKEFIAWLVKGGP | Gly$^{8, 36}$, Glu$^{22}$, Pro$^{37}$-GLP-1(7-37) |
| 3196 | HVEGTFTSDVSSYLEEQAAKEFIAWLVKGGP | Val$^8$, Glu$^{22}$, Gly$^{36}$, Pro$^{37}$-GLP-1(7-37) |
| 3197 | HGEGTFTSDVSSYLEEQAAKEFIAWLKNGGP | Gly$^{8, 36}$, Glu$^{22}$, Lys$^{33}$, Asn$^{34}$, Pro$^{37}$-GLP-1(7-37) |
| 3198 | HVEGTFTSDVSSYLEEQAAKEFIAWLKNGGP | Val$^8$, Glu$^{22}$, Lys$^{33}$, Asn$^{34}$, Gly$^{36}$, Pro$^{37}$-GLP-1(7-37) |
| 3199 | HGEGTFTSDVSSYLEEQAAKEFIAWLVKGG | Gly$^{8, 36}$, Glu$^{22}$-GLP-1(7-36) |
| 3200 | HVEGTFTSDVSSYLEEQAAKEFIAWLVKGG | Val$^8$, Glu$^{22}$, Gly$^{36}$-GLP-1(7-36) |
| 3201 | HVEGTFTSDVSSYLEEQAAKEFIAWLVNGG | Val$^8$, Glu$^{22}$, Asn$^{34}$, Gly$^{36}$-GLP-1(7-36) |
| 3202 | HGEGTFTSDVSSYLEEQAAKEFIAWLVNGG | Gly$^{8, 36}$, Glu$^{22}$, Asn$^{34}$-GLP-1(7-36) |
| 3203 | AESKYGPPCPPCPAPXaa$_{16}$Xaa$_{17}$Xaa$_{18}$GGPSVFLFPPKPKDTLMISRTPEVTCVVVDVSQEDPEVQFNWYVDGVEVHNAKTKPREEQFXaa$_{80}$STYRVVSVLTVLHQDWLNGKEYKCKVSNKGLPSSIEKTISKAKGQPREPQVYTLPPSQEEMTKNQVSLTCLVKGFYPSDIAVEWESNCQPENNYKTTPPVLDSDGSFFLYSRLTVDKSRWQEGNVFSCSVMHEALHNHYTQKSLSLSLGXaa$_{230}$ | Fc portion of an immunoglobulin |

TABLE 7 -continued

Examples of GLP-1 Agonist Sequences

| SEQ ID NO: | Sequence | Description |
|---|---|---|
| | wherein $Xaa_{16}$ is P or E<br>$Xaa_{17}$ is F, V or A<br>$Xaa_{18}$ is L, E or A<br>$Xaa_{80}$ is N or A<br>and $Xaa_{230}$ is K or absent. | |
| 3204 | $(-GGGGS-)_x$ where x is 1, 2, 3, 4, 5 or 6 | Linker |
| 3205 | HGEGTFTSDVSSYLEEQAAKEFIAWLVK GGGGGGGSGGGGSGGGGSAESKYGPPCP PCPAPEAAGGPSVFLEPPKPKDTLMISR TPEVTCVVVDVSQEDPEVQFNWYVDGVE VHNAKTKPREEQENSTYRVVSVLTVLHQ DWLNGKEYKCKVSNKGLPSSIEKTISKA KGQPREPQVYTLPPSQEEMTKNQVSLTC LVKGEYPSDIAVEWESNGQPENNYKTTP PVLDSDGSEFLYSR LTVDKSRWQEGNVFSCSVMHEALENHYT QKSLSLSLG | Fc portion of an immunoglobulin |
| 3206 | $HXaa_8EGTFTSDVS$ $SYLEXaa_{22}QAAKEFIAWLXaa_{33}KGGPSS$ $CAPPPC_{45}C_{46}-Z$, wherein $Xaa_8$ is: D-Ala, G, V, L, I, S or T<br>$Xaa_{22}$ is C, E, D or K<br>$Xaa_{33}$ is: V or I<br>and Z is OH or $NH_2$ and, optionally, wherein (i) one polyethylene glycol moiety is covalently attached to $C_{45}$, (ii) one polyethylene glycol moiety is covalently attached to $C_{46}$, or (iii) one polyethylene glycol moiety is attached to $C_{45}$, and one polyethylene glycol moiety is attached to $C_{46}$. | GLP analog |
| 3207 | HVECTETSDVSSYLEEQAAKEFIAWLIK $GGPSSGAPPPC_{45}C_{46}-NH_2$ and, optionally, wherein (i) one polyethylene glycol moiety is covalently attached to $C_4$, (ii) one polyethylene glycol moiety is covalently attached to $C_{46}$, or (iii) one polyethylene glycol moiety is attached to $C_{45}$ and one polyethylene glycol moiety is attached to $C_{46}$ | GLP analog |
| 3208 | HGEGTFTSDLSKQMEEEAVKLFIEWLKN GGPSSGAPPPS | [$N^\epsilon$-(17-carboxyheptadecanoic acid)$Lys^{20}$]exendin-4-$NH_2$ |
| 3209 | HGEGTFTSDLSKQMEEEAVRLFIEWLKN GGPKSGAPPPS | [$N^\epsilon$-(17-carboxyhepta-decanoyl)$Lys^{32}$]exendin-4-$NH_2$ |
| 3210 | GEGTFTSDLSKQMEEEAVKLFIEWLKNG GPSSGAPPPS | [desamino-$His^1$, $N^\epsilon$-(17-carboxyheptadecanoyl)$Lys^{20}$]exendin-4-$NH_2$ |
| 3211 | HGEGTFTSDLSRQNorLeEEEAVRLFIE WLRNGGPKSGAPPPS | [$Arg^{12, 27}$, $NLe^{14}$, $N^\epsilon$-(17-carboxy heptadecanoyl)$Lys^{32}$]exendin-4-$NH_2$ |
| 3212 | HGEGTFTSDLSKQMEEEAVKLFIEWLKN GGPSSGAPPPS | [$N^\epsilon$-(19-carboxy-nonadecanoylamino)$Lys^{20}$]-exendin-4-$NH_2$ |
| 3213 | HGEGTFTSDLSKQMEEEAVKLFIEWLKN GGPSSGAPPPS | [$N^\epsilon$-(15-carboxypentadecanoylamino)$Lys^{20}$]-exendin-4-$NH_2$ |

TABLE 7 -continued

Examples of GLP-1 Agonist Sequences

| SEQ ID NO: | Sequence | Description |
|---|---|---|
| 3214 | HGEGTFTSDLSKQMEEEAVKLFIEWLKN GGPSSGAPPPS | [N$^\epsilon$-(13-carboxytridecanoylamino)Lys$^{20}$] exendin-4-NH$_2$ |
| 3215 | HGEGTFTSDLSKQMEEEAVKLFIEWLKN GGPSSGAPPPS | [N$^\epsilon$-(11-carboxy-undecanoyl-amino)Lys$^{20}$]exendin-4-NH$_2$ |
| 3216 | HGEGTFTSDLSKQMEEEAVRLFIEWLKN GGPSSGAPPPSK | exendin-4-Lys$^{40}$(e-MPA)-NH$_2$ |
| 3217 | HGEGTFTSDLSKQMEEEAVRLFIEWLKN GGPSSGAPPPSK | exendin-4-Lys$^{40}$(e-AEEA-AEEA-MPA)-NH$_2$ |
| 3218 | HGEGTFTSDLSKQMEEEAVRLFIEWLKN GGPSSGAPPPSK | exendin-4-Lys$^{40}$(e-AEEA-MPA)-NH$_2$ |
| 3219 | HGEGTFTSDLSKQMEEEAVRLFIEWLKN GGPSSGAPPPSK | exendin-4-Lys$^{40}$(e-MPA)-albumnin |
| 3220 | HGEGTFTSDLSKQMEEEAVRLFIEWLKN GGPSSGAPPPSK | exendin-4-Lys$^{40}$(e-AEEA-AEEA-MPA)-albumin |
| 3221 | HGEGTFTSDLSKQMEEEAVRLFIEWLKN GGPSSGAPPPSK | exendin-4-Lys$^{40}$(e-AEEA-MPA)-albumin |
| 3222 | AEGTFTSDVSSYLEGQAAREFIAWLVKG RG | desamino-His$^7$, Arg$^{26}$, Lys$^{34}$(N$^\epsilon$-($\gamma$-Glu(N-$\alpha$-hexadecanoyl)))-GLP-1(7-37) (core peptide disclosed as SEQ ID NO: 3222) |
| 3223 | AEGTFTSDVSSYLEGQAAREFIAWLVKG RG | desamino-His$^7$, Arg$^{20}$, Lys$^{34}$ (N$^\epsilon$-octanoyl)-GLP-1(7-37) |
| 3224 | HAEGTFTSDVSSYLEGQAAREFIAWLVR GRGK | Arg$^{26, 34}$, Lys$^{38}$(N$^\epsilon$-($\omega$-carboxypentadecanoyl))-GLP-1(7-38) |
| 3225 | HAEGTFTSDVSSYLEGQAAREFIAWLVR GRGK | Asg$^{26, 34}$, Lys$^{36}$(N$^\epsilon$-($\gamma$-Glu(N-$\alpha$-hexadecanoyl)))-GLP-1(7-36) (core peptide disclosed as SEQ ID NO: 3225) |

AEEA refers to [2-(2-amino)ethoxy)]acetic acid
EDA refers to ethylenediamine.
MPA refers to maleimidopropionic acid.

The disclosure also provides pharmaceutical compositions comprising the GLP-1 receptor agonist compounds described herein and a pharmaceutically acceptable carrier. The GLP-1 receptor agonist compounds can be present in the pharmaceutical composition in a therapeutically effective amount and can be present in an amount to provide a minimum blood plasma level of the GLP-1 receptor agonist compound necessary for therapeutic efficacy. Such pharmaceutical compositions are known in the art and described, e.g., in U.S. Pat. Nos. 7,521,423; 7,456,254; WO 2000/037098; WO 2005/021022; WO 2005/102293; WO 2006/068910; WO 2006/125763; WO 2009/068910; US Publication No. 2004/0106547; and the like, the disclosures of which are incorporated herein by reference.

Pharmaceutical compositions containing the GLP-1 receptor agonist compounds described herein may be provided for peripheral administration, such as parenteral (e.g., subcutaneous, intravenous, intramuscular), a continuous infusion (e.g., intravenous drip, intravenous bolus, intravenous infusion), topical, nasal, or oral administration. Suitable pharmaceutically acceptable carriers and their formulation are described in standard formulation treatises, such as Remington's Pharmaceutical Sciences by Martin; and Wang et al., Journal of Parenteral Science and Technology, Technical Report No. 10, Supp. 42:2S (1988). The GLP-1 receptor agonist compounds described herein can be provided in parenteral compositions for injection or infusion. They can, for example, be suspended in water; an inert oil, such as a vegetable oil (e.g., sesame, peanut, olive oil, and the like); or other pharmaceutically acceptable carrier. In one embodiment, the compounds are suspended in an aqueous carrier, for example, in an isotonic buffer solution at a pH of about 3.0 to 8.0, or about 3.0 to 5.0. The compositions may be sterilized by conventional sterilization techniques or may be sterile filtered. The compositions may contain pharmaceutically acceptable auxiliary substances as required to approximate physiological conditions, such as pH buffering agents.

Useful buffers include for example, acetic acid buffers. A form of repository or "depot" slow release preparation may be used so that therapeutically effective amounts of the preparation are delivered into the bloodstream over many hours or days following subcutaneous injection, transdermal injection or other delivery method. The desired isotonicity may be accomplished using sodium chloride or other pharmaceutically acceptable agents such as dextrose, boric acid, sodium tartrate, propylene glycol, polyols (such as mannitol and sorbitol), or other inorganic or organic solutes. In one embodiment for intravenous infusion, the formulation may comprise (i) the GLP-1 receptor agonist compound, (2) sterile water, and, optionally (3) sodium chloride, dextrose, or a combination thereof Carriers or excipients can also be used to facilitate administration of the GLP-1 receptor agonist compounds. Examples of carriers and excipients include calcium carbonate, calcium phosphate, various sugars such as lactose, glucose, or sucrose, or types of starch, cellulose derivatives, gelatin, vegetable oils, polyethylene glycols and physiologically compatible solvents.

The GLP-1 receptor agonist compounds can also be formulated as pharmaceutically acceptable salts (e.g., acid addition salts) and/or complexes thereof. Pharmaceutically acceptable salts are non-toxic salts at the concentration at which they are administered. Pharmaceutically acceptable salts include acid addition salts such as those containing sulfate, hydrochloride, phosphate, sulfamate, acetate, citrate, lactate, tartrate, methanesulfonate, ethanesulfonate, benzenesulfonate, p-toluenesulfonate, cyclohexylsulfamate and quinate. Pharmaceutically acceptable salts can be obtained from acids such as hydrochloric acid, sulfuric acid, phosphoric acid, sulfamic acid, acetic acid, citric acid, lactic acid, tartaric acid, malonic acid, methanesulfonic acid, ethanesulfonic acid, benzenesulfonic acid, p-toluenesulfonic acid, cyclohexylsulfamic acid, and quinic acid. Such salts may be prepared by, for example, reacting the free acid or base forms of the product with one or more equivalents of the appropriate base or acid in a solvent or medium in which the salt is insoluble, or in a solvent such as water which is then removed in vacuo or by freeze-drying or by exchanging the ions of an existing salt for another ion on a suitable ion exchange resin.

Exemplary pharmaceutical formulations of GLP-1 receptor agonist compounds are described in U.S. Pat. Nos. 7,521,423, 7,456,254; US Publication No 2004/0106547, WO 2006/068910, WO 2006/125763, and the like, the disclosures of which are incorporated by reference herein.

The therapeutically effective amount of the GLP-1 receptor agonist compounds described herein for use in the methods described herein will typically be from about 0.01 μg to about 5 mg; about 0.1 μg to about 2.5 mg; about 1 μg to about 1 mg; about 1 μg to about 50 μg; or about 1 μg to about 25 μg. Alternatively, the therapeutically effective amount of the GLP-1 receptor agonist compounds may be from about 0.001 μg to about 100 μg based on the weight of a 70 kg patient; or from about 0.01 μg to about 50 μg based on the weight of a 70 kg patient. These therapeutically effective doses may be administered once/day, twice/day, thrice/day, once/week, biweekly, or once/month, depending on the formulation. The exact dose to be administered is determined, for example, by the formulation, such as an immediate release formulation or an extended release formulation. For transdermal, nasal or oral dosage forms, the dosage may be increased from about 5-fold to about 10-fold.

In certain embodiments the GLP-1 receptor agonist will be administered concurrently with the GIPR antigen binding protein. In one embodiment the GLP-1 receptor agonist will be administered after the GIPR antigen binding protein. In one embodiment the GLP-1 receptor agonist will be administered before the GIPR antigen binding protein. In certain embodiments the subject or patient will already be being treated with a GLP-1 receptor agonist before being subjected to further treatment with a GIPR antigen binding protein.

The GIPR antigen binding proteins that are provided herein are useful for detecting GIPR in biological samples. For instance, the GIPR antigen binding proteins can be used in diagnostic assays, e.g., binding assays to detect and/or quantify GIPR expressed in serum.

The antigen binding proteins of the described can be used for diagnostic purposes to detect, diagnose, or monitor diseases and/or conditions associated with GIPR. The disclosed antigen binding proteins provide a means for the detection of the presence of GIPR in a sample using classical immunohistological methods known to those of skill in the art (e.g., Tijssen, 1993, *Practice and Theory of Enzyme Immunoassays*, Vol 15 (Eds R. H. Burdon and P. H. van Knippenberg, Elsevier, Amsterdam); Zola, 1987, *Monoclonal Antibodies: A Manual of Techniques*, pp. 147-158 (CRC Press, Inc.); Jalkanen et al., 1985, *J. Cell. Biol.* 101:976-985; Jalkanen et al., 1987, *J. Cell Biol.* 105:3087-3096). The detection of GIPR can be performed in vivo or in vitro.

Diagnostic applications provided herein include use of the antigen binding proteins to detect expression of GIPR. Examples of methods useful in the detection of the presence of GIPR include immunoassays, such as the enzyme linked immunosorbent assay (ELISA) and the radioimmunoassay (RIA).

For diagnostic applications, the antigen binding protein typically will be labeled with a detectable labeling group. Suitable labeling groups include, but are not limited to, the following: radioisotopes or radionuclides (e.g., $^{3}$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and may be used.

In some embodiments, the GIPR antigen binding protein is isolated and measured using techniques known in the art. See, for example, Harlow and Lane, 1988, *Antibodies: A Laboratory Manual*, New York: Cold Spring Harbor (ed. 1991 and periodic supplements); John E. Coligan, ed., 1993, *Current Protocols In Immunology* New York: John Wiley & Sons.

Another aspect of the disclosed provides for detecting the presence of a test molecule that competes for binding to GIPR with the antigen binding proteins provided. An example of one such assay would involve detecting the amount of free antigen binding protein in a solution containing an amount of GIPR in the presence or absence of the test molecule. An increase in the amount of free antigen binding protein (i.e., the antigen binding protein not bound to GIPR) would indicate that the test molecule is capable of competing for GIPR binding with the antigen binding protein. In one embodiment, the antigen binding protein is labeled with a labeling group. Alternatively, the test molecule is labeled and the amount of free test molecule is monitored in the presence and absence of an antigen binding protein.

GIPR binding proteins can be used to treat, diagnose or ameliorate, a metabolic condition or disorder. In one embodiment, the metabolic disorder to be treated is diabetes, e.g., type 2 diabetes. In another embodiment, the metabolic condition or disorder is obesity. In other embodiments the metabolic condition or disorder is dyslipidemia, elevated glucose levels, elevated insulin levels or diabetic nephropathy. For example, a metabolic condition or disorder that can be treated or ameliorated using a GIPR binding peptide includes a state in which a human subject has a fasting blood glucose level of 125 mg/dL or greater, for example 130, 135, 140, 145, 150, 155, 160, 165, 170, 175, 180, 185, 190, 195, 200 or greater than 200 mg/dL. Blood glucose levels can be determined in the fed or fasted state, or at random. The metabolic condition or disorder can also comprise a condition in which a subject is at increased risk of developing a metabolic condition. For a human subject, such conditions include a fasting blood glucose level of 100 mg/dL. Conditions that can be treated using a pharmaceutical composition comprising a GIPR binding protein can also be found in the American Diabetes Association Standards of Medical Care in Diabetes Care-2011, American Diabetes Association, Diabetes Care Vol. 34, No. Supplement 1, S11-S61, 2010, incorporated herein by reference.

In application, a metabolic disorder or condition, such as Type 2 diabetes, elevated glucose levels, elevated insulin levels, dyslipidemia, obesity or diabetic nephropathy, can be treated by administering a therapeutically effective dose of a GIPR binding protein to a patient in need thereof. The administration can be performed as described herein, such as by IV injection, intraperitoneal (IP) injection, subcutaneous injection, intramuscular injection, or orally in the form of a tablet or liquid formation. In some situations, a therapeutically effective or preferred dose of a GIPR binding protein can be determined by a clinician. A therapeutically effective dose of GIPR binding protein will depend, inter alia, upon the administration schedule, the unit dose of agent administered, whether the GIPR binding protein is administered in combination with other therapeutic agents, the immune status and the health of the recipient. The term "therapeutically effective dose," as used herein, means an amount of GIPR binding protein that elicits a biological or medicinal response in a tissue system, animal, or human being sought by a researcher, medical doctor, or other clinician, which includes alleviation or amelioration of the symptoms of the disease or disorder being treated, i.e., an amount of a GIPR binding protein that supports an observable level of one or more desired biological or medicinal response, for example lowering blood glucose, insulin, triglyceride, or cholesterol levels; reducing body weight; or improving glucose tolerance, energy expenditure, or insulin sensitivity.

It is noted that a therapeutically effective dose of a GIPR binding protein can also vary with the desired result. Thus, for example, in situations in which a lower level of blood glucose is indicated a dose of GIPR binding protein will be correspondingly higher than a dose in which a comparatively lower level of blood glucose is desired. Conversely, in situations in which a higher level of blood glucose is indicated a dose of GIPR binding protein will be correspondingly lower than a dose in which a comparatively higher level of blood glucose is desired.

In various embodiments, a subject is a human having a blood glucose level of 100 mg/dL or greater can be treated with a GIPR binding protein.

In one embodiment, a method of the instant disclosure comprises first measuring a baseline level of one or more metabolically-relevant compounds such as glucose, insulin, cholesterol, lipid in a subject. A pharmaceutical composition comprising a GIPR binding protein is then administered to the subject. After a desired period of time, the level of the one or more metabolically-relevant compounds (e.g., blood glucose, insulin, cholesterol, lipid) in the subject is again measured. The two levels can then be compared in order to determine the relative change in the metabolically-relevant compound in the subject. Depending on the outcome of that comparison another dose of the pharmaceutical composition comprising a GIPR binding protein can be administered to achieve a desired level of one or more metabolically-relevant compound.

It is noted that a pharmaceutical composition comprising a GIPR binding protein can be co-administered with another compound. The identity and properties of compound co-administered with the GIPR binding protein will depend on the nature of the condition to be treated or ameliorated. A non-limiting list of examples of compounds that can be administered in combination with a pharmaceutical composition comprising a GIPR binding protein include rosiglitizone, pioglitizone, repaglinide, nateglitinide, metformin, exenatide, stiagliptin, pramlintide, glipizide, glimepriridea-carbose, and miglitol.

Also provided are kits for practicing the disclosed methods. Such kits can comprise a pharmaceutical composition such as those described herein, including nucleic acids encoding the peptides or proteins provided herein, vectors and cells comprising such nucleic acids, and pharmaceutical compositions comprising such nucleic acid-containing compounds, which can be provided in a sterile container. Optionally, instructions on how to employ the provided pharmaceutical composition in the treatment of a metabolic disorder can also be included or be made available to a patient or a medical service provider.

In one aspect, a kit comprises (a) a pharmaceutical composition comprising a therapeutically effective amount of a GIPR binding protein; and (b) one or more containers for the pharmaceutical composition. Such a kit can also comprise instructions for the use thereof; the instructions can be tailored to the precise metabolic disorder being treated. The instructions can describe the use and nature of the materials provided in the kit. In certain embodiments, kits include instructions for a patient to carry out administration to treat a metabolic disorder, such as elevated glucose levels, elevated insulin levels, obesity, type 2 diabetes, dyslipidemia or diabetic nephropathy.

Instructions can be printed on a substrate, such as paper or plastic, etc., and can be present in the kits as a package insert, in the labeling of the container of the kit or components thereof (e.g., associated with the packaging), etc. In other embodiments, the instructions are present as an electronic storage data file present on a suitable computer readable storage medium, e.g. CD-ROM, diskette, etc. In yet other embodiments, the actual instructions are not present in the kit, but means for obtaining the instructions from a remote source, such as over the internet, are provided. An example of this embodiment is a kit that includes a web address where the instructions can be viewed and/or from which the instructions can be downloaded.

Often it will be desirable that some or all components of a kit are packaged in suitable packaging to maintain sterility. The components of a kit can be packaged in a kit containment element to make a single, easily handled unit, where the kit containment element, e.g., box or analogous structure, may or may not be an airtight container, e.g., to further preserve the sterility of some or all of the components of the kit.

EXAMPLE 1

Generation of anti-murine GIPR antibody. Immunizations were done in 129X BL/6 mice from Charles River by GeneGun with a pool of DNA (pTT5:E3K-muGIPR-E3K and pTT5:Mut1-mGIPR-Mut1) and CA-64. B-Cells were harvested from the mice with highest titers and fused with Sp2/0-Ag14 cells creating hybridomas. Antibodies were produced from hybridomas cultured in hyperflasks at 37 C. Antibody was purified from cultured media by affinity chromatography (protein A FF, high salt/pH method) followed by a buffer exchange (UF/DF). N-terminal sequencing of variable domains was done using hybridomas. RNA was isolated from hybridoma lysate and converted to cDNA by TOPO-TA cloning of RACE PCR products. The light chain and heavy chain sequences were confirmed by LC/MS. The original isotype of the hybridoma antibodies were murine IgG2a. The subtype was changed to aglycosylated muIgG1 (N297 to G mutation) to be effector functionless. The recombinant sequence was cloned by GeneArt seamless cloning into pTT5 and pSLX240 for 293-6E mammalian transient and CHO S mammalian stable expression, respectively. Expression productions were done for 6 days in shake flasks at 36° C. Cultured media was harvested for purification. All protein lots were purified by affinity chromatography (Mab Select SuRe) followed by cation exchange (SP Sepharose HP) and finishing with a buffer exchange (UF/DF) into A5.2Su buffer. Protein analytics (size exclusion chromatography) showed all lots to contain >98% main peak with <1% high molecular weight species.

EXAMPLE 2

Figure 2B:
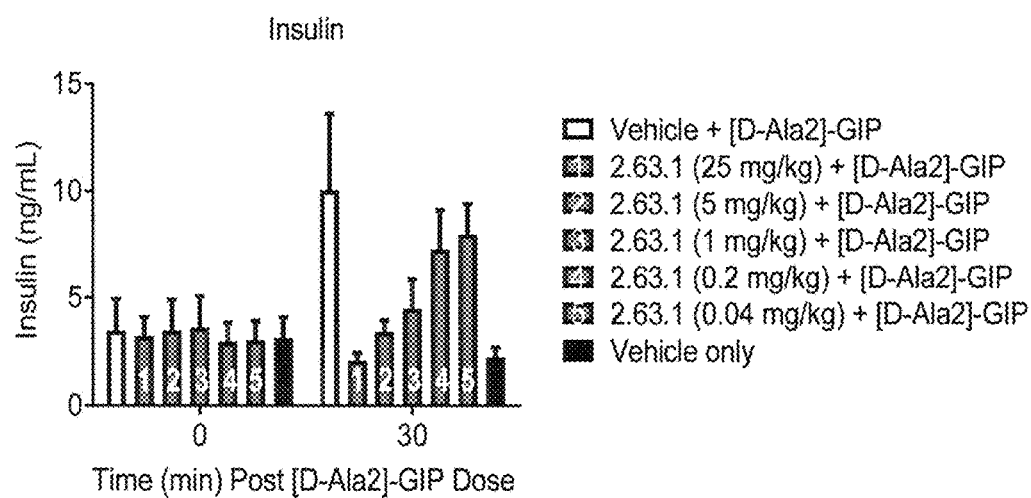

FIG. 1 provides an overview of the pharmacodynamics assay to test anti-murine GIPR antibodies. Seven week old male high fat diet (HFD)-induced obese C57BL/6 mice were purchased from Jackson Labs. After arrival, mice were continued on high fat diet with Research Diets D12492 (60 kcal % fat) (Research diet) for one to two weeks. Mice were randomized by body weight and were administrated intraperitoneally with testing GIPR antibody or vehicle (10 mM acetate, 150 mM NaCl, pH 5.0) the day before intraperitoneal glucose tolerance test (IPGTT). Mice were fasted for 7 hours and IPGTT was performed immediately following exogenous GIP [D-Ala2]-GIP (50 nmol/kg, Phoenix Pharmaceuticals) given intraperitoneally. Blood samples were taken from tail nick at the times indicated. Glucose was measured using AlphaTrak blood glucose meter (Abbott). Blood insulin level was determined by using Insulin (mouse) ultra-sensitive EIA kit (ALPCO Diagnostics). Results are shown in FIG. 2 and show that the anti-murine GIPR antibody 2.63.1 antagonizes GIP induced insulin secretion. 2.63.1 comprises a light chain with the following sequence:

```
                                      (SEQ ID NO: 3161)
MKLPVRLLVL MFWIPASSSD VVMTQTPLSL PVSLGDQASI

SCRSSQSLVH SNGDTYLHWY LQKPGQSPKL LIYKVSNRFS

GVPDRFSGSG SGTDFTLKIS RVEAADLGVY FCSQSTHVPP

FTFGGGTKLE IKRADAAPTV SIFPPSSEQL TSGGASVVCF

LNNFYPKDIN VKWKIDGSER QNGVLNSWTD QDSKDSTYSM

SSTLTLTKDE YERHNSYTCE ATHKTSTSPI VKSFNRNEC
```

And 2.63.1 comprises a heavy chain with the following sequence:

```
                                      (SEQ ID NO: 3162)
MGWSYTILFL VATATDVHSQ VQLQQPGAEL VKPGASVKLS

CRASGYTFTS NWMHWVKQRP RQGLEWIGEI NPSNGRSNYN

EKFKTKATLT VDKSSSTAYM QLSSLTSEDS AVYYCARFYY

GTSWFAYWGQ GTLVAVSAAK TTPPSVYPLA PGSAAQTNSM

VTLGCLVKGY FPEPVTVTWN SGSLSSGVHT FPAVLQSDLY

TLSSSVTVPS STWPSETVTC NVAHPASSTK VDKKIVPRDC

GCKPCICTVP EVSSVFIFPP KPKDVLTITL TPKVTCVVVD

ISKDDPEVQF SWFVDDVEVH TAQTQPREEQ FASTFRSVSE

LPIMHQDWLN GKEFKCRVNS AAFPAPIEKT ISKTKGRPKA

PQVYTIPPPK EQMAKDKVSL TCMITDFFPE DITVEWQWNG

QPAENYKNTQ PIMDTDGSYF VYSKLNVQKS NWEAGNTFTC

SVLHEGLHNH HTEKSLSHSP GK .
```

In one embodiment the present invention is directed to an anti-murine GIPR antibody comprising a light chain comprising SEQ ID NO: 3161 and a heavy chain comprising SEQ ID NO: 3162. In one embodiment the present invention is directed to an anti-murine GIPR antibody comprising a light chain variable region from SEQ ID NO: 3161 and a heavy chain variable region from SEQ ID NO: 3162. In one embodiment the present invention is directed to an anti-murine GIPR antibody comprising CDRL1, CDRL2, and CDRL3 from SEQ ID NO: 3161 and a CDRH1, CDRH2, and CDRH3 from SEQ ID NO: 3162.

EXAMPLE 3

FIG. 3 provides an overview of the study used to determine the effects of chronic treatment of diet induced obese (DIO) mice with the 2.63.1 antibody. 18 week old male C57BL/6 DIO mice fed Research Diets D12492 (60 kcal % fat) were randomized into groups. Treatments were given twice a week intraperitoneally for 6 weeks. Blood glucose levels were measured from tail nick using a glucose meter (Abbott) after mice were fasted for 4 hours. Insulin levels were determined using mouse high range insulin ELISA (ALPCO Diagnostics). Triglyceride levels were measured using an Infinity triglyceride assay kit (Thermo Scientific). Total cholesterol was measured using an Infinity total cholesterol kit (Thermo Scientific). Body composition was determined using the minispec whole body composition analyzer (Bruker).

Figure 4:
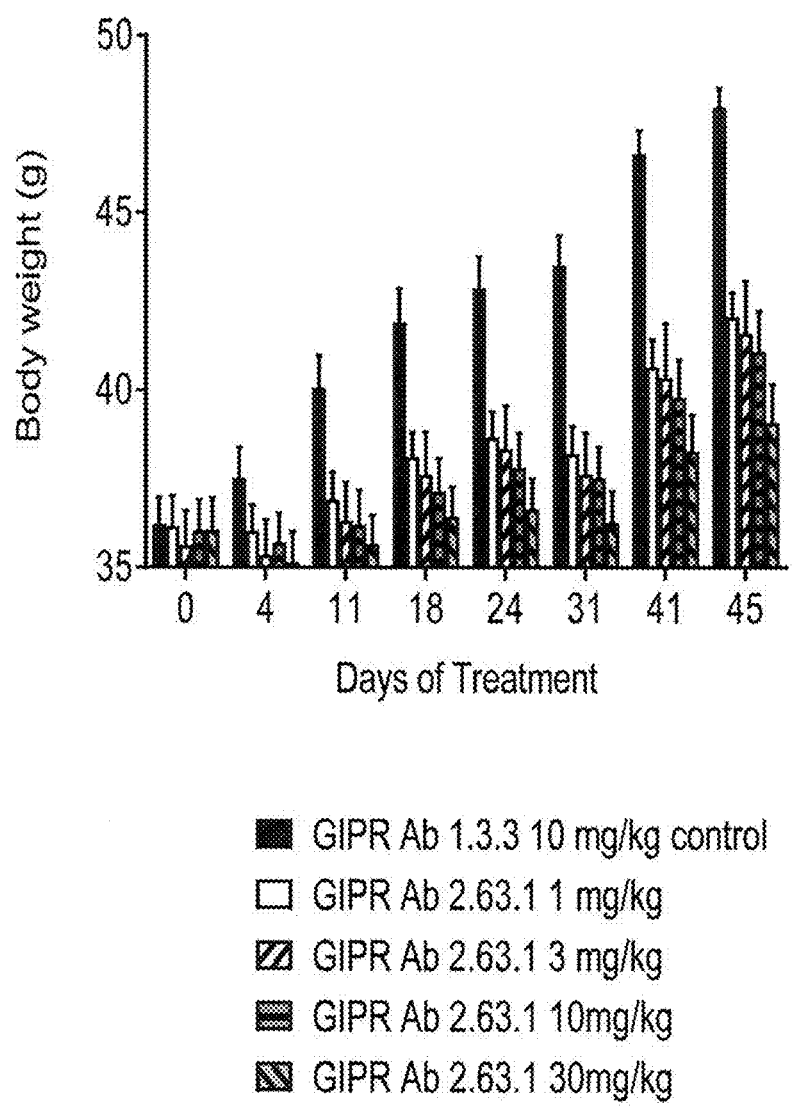
Figure 5A:
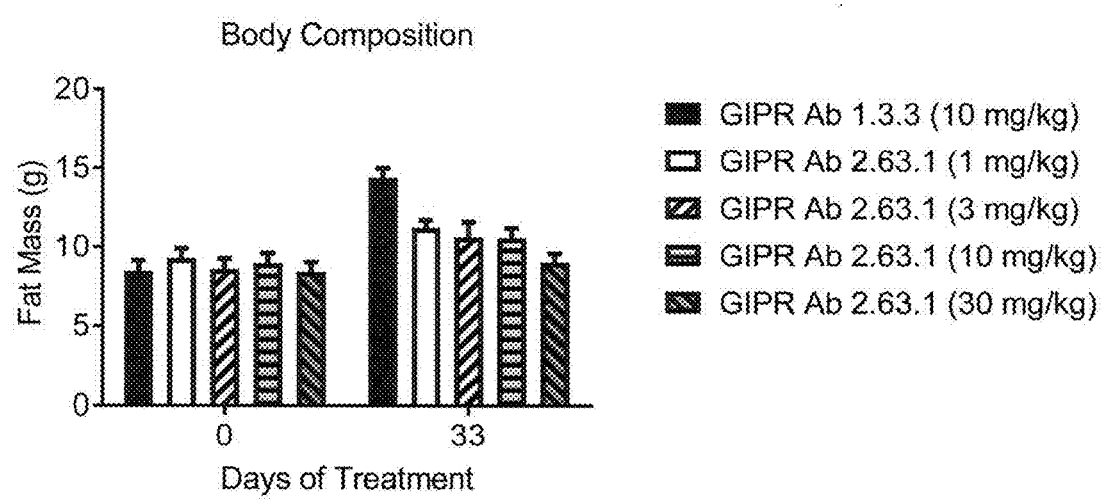
(FIG. 5A) Fat Mass, (FIG. 5B) Lean Mass, (FIG. 5C) Percent Fat Mass, and (FIG. 5D) Percent Lean mass of mice treated with GIPR Antibody 2.63.1
Figure 5B:
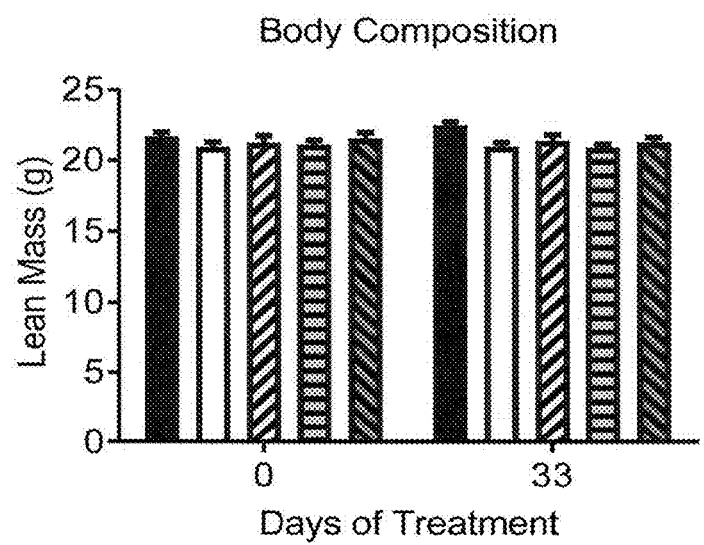
Figure 5C:
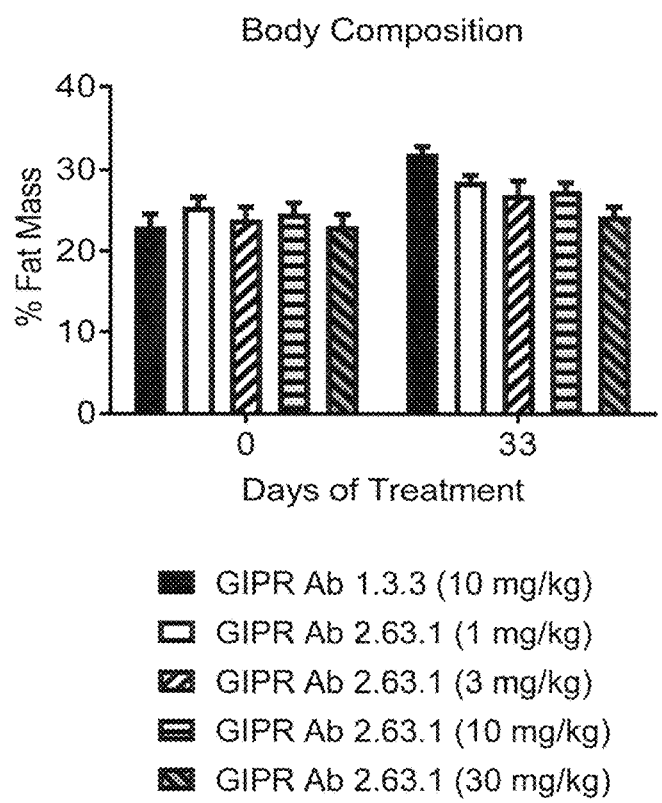
Figure 5D:
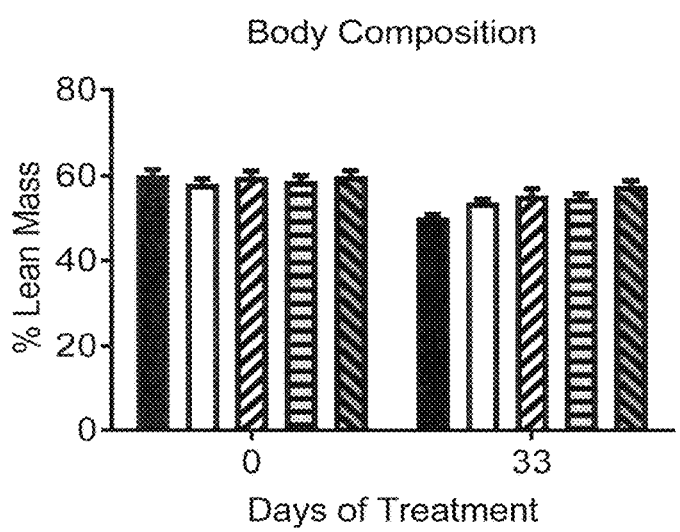
Figure 7A:
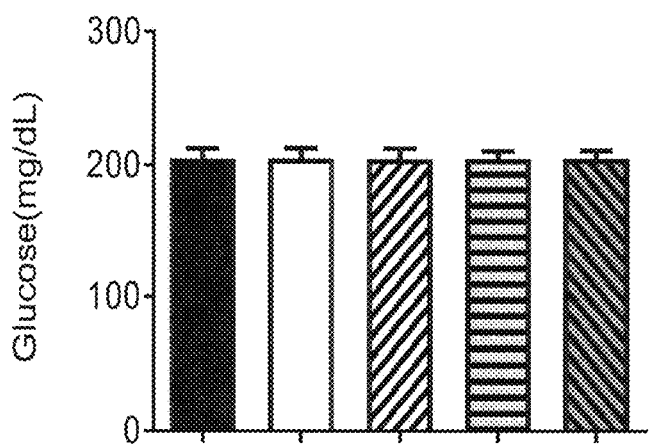
Figure 7B:
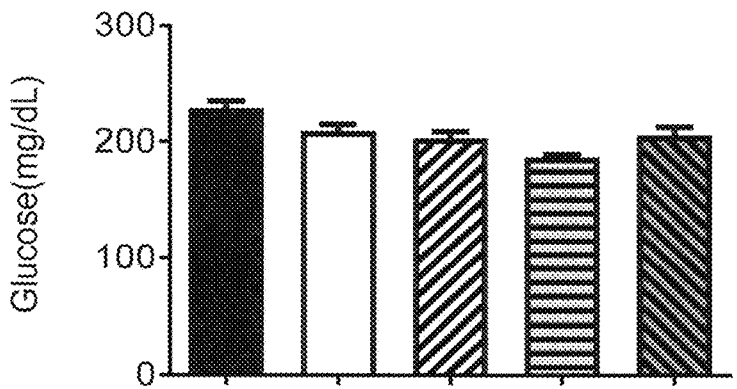
Figure 7C:
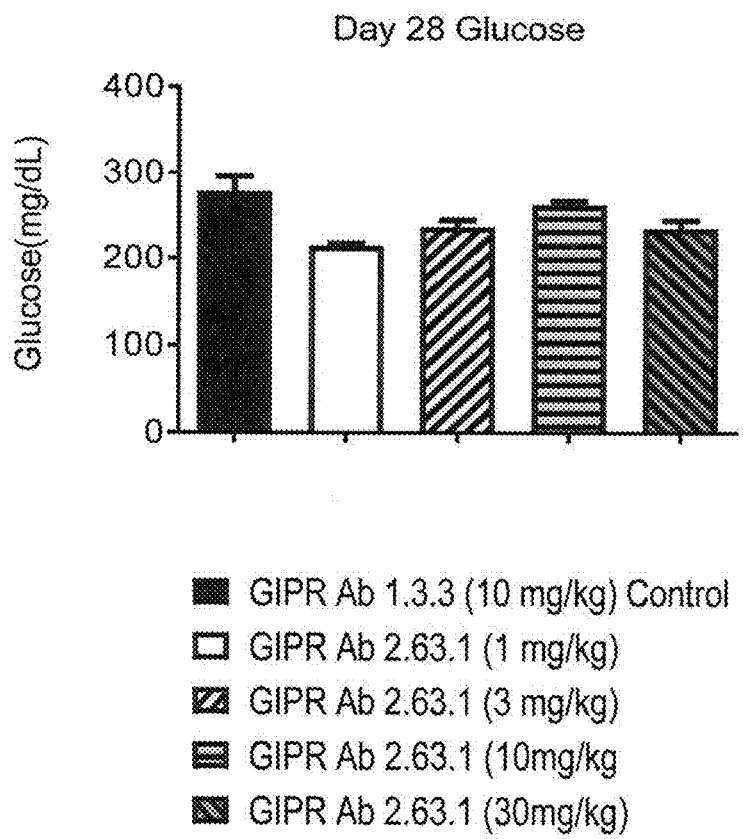
Figure 7D:
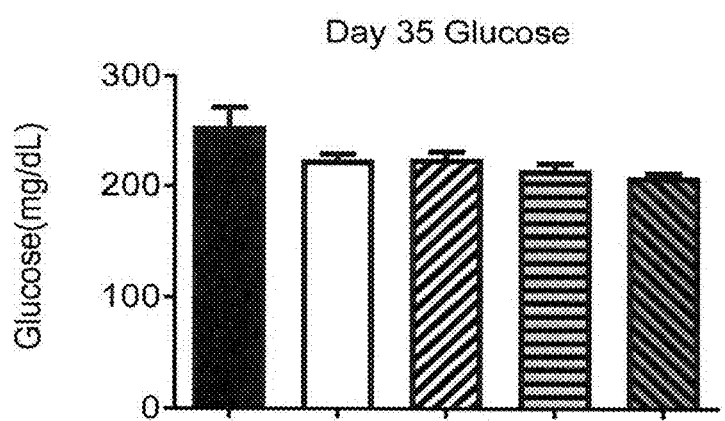
Figure 8:
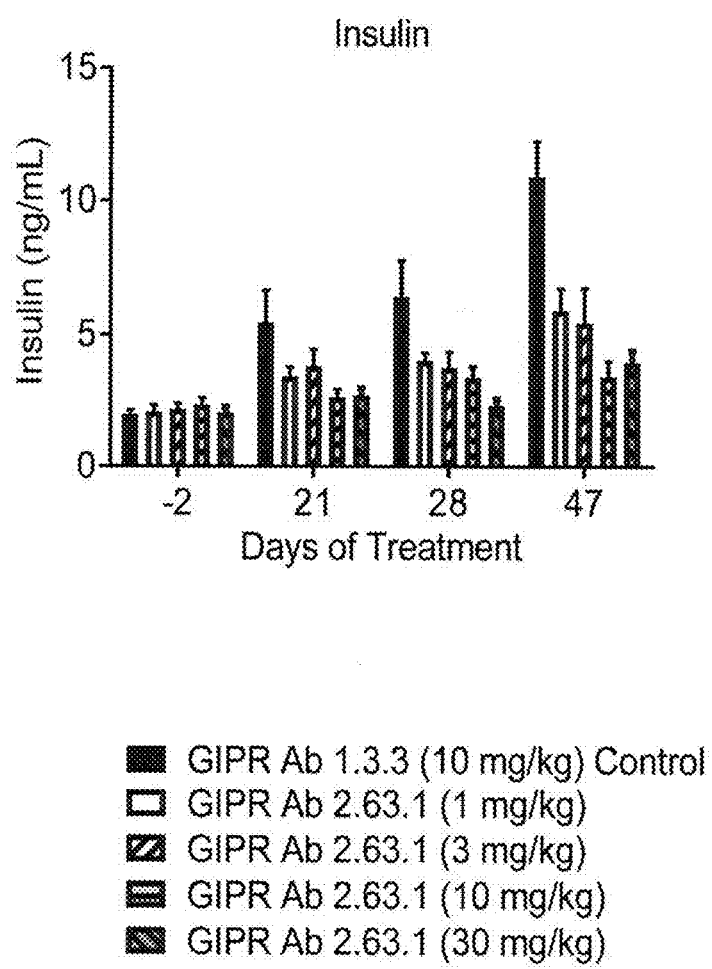
FIG. 8. GIPR Antibody 2.63.1 Results In Lower Insulin Levels
Figure 9A:
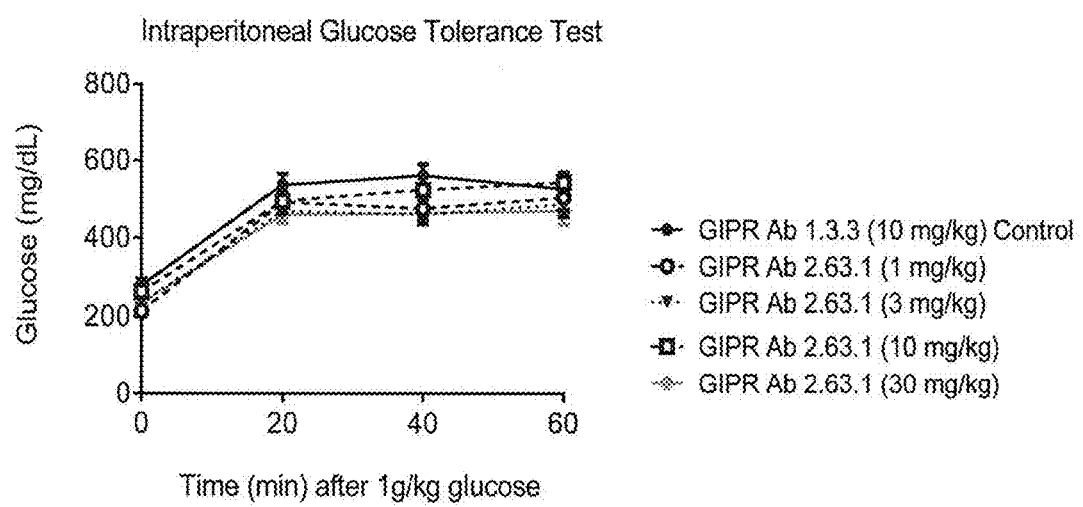
FIG. 9A-9B. GIPR Antibody 2.63.1 Results In Improved Glucose Tolerance as shown by (FIG. 9A) glucose levels and (FIG. 9B) AUC FIG. 10A-10B. GIPR Antibody 2.63.1 Results In (FIG. 10A) Lower Serum Total Cholesterol And (FIG. 10B) Triglycerides FIG. 11. GIPR Antibody 2.63.1 Results In A Reduction In Hepatocyte Microvesicular Change And Corresponding Lipid Accumulation FIG. 12A-12B. GIPR Antibody 2.63.1 Results In (FIG. 12A) Reduced Liver Weight And (FIG. 12B) Triglyceride Content FIG. 13. Reduced Inflammation And Reduced Infiltrating Macrophages Cells Surrounding Adipocytes In Epididymal White Adipose Tissue With GIPR Antibody 2.63.1 Treatment FIGS. 14A-14Z and 14AA-14HH. The graphs summarize the measured dissociation rate constant (1/s) for the tested samples binding with huGIPR ECD as well as IC60 values for inhibition of GIP binding to huGIPR ECD.
Figure 9B:
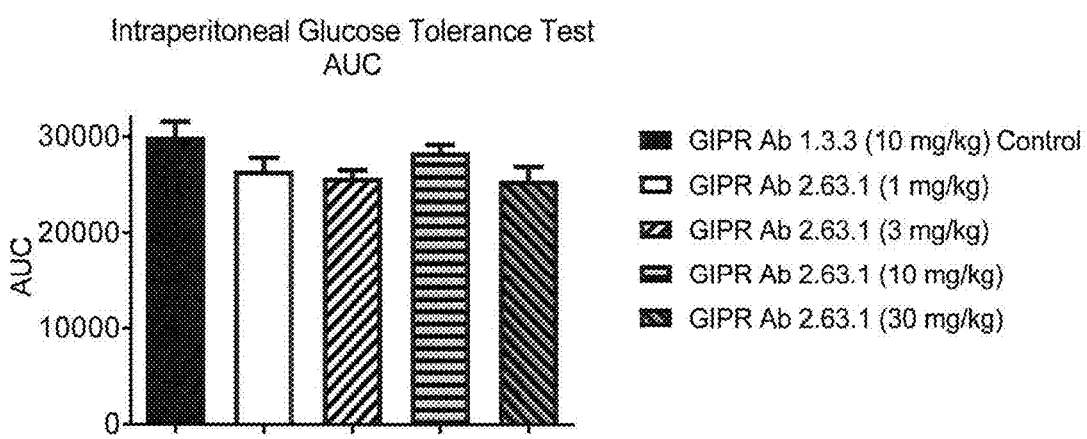
Figure 10A:
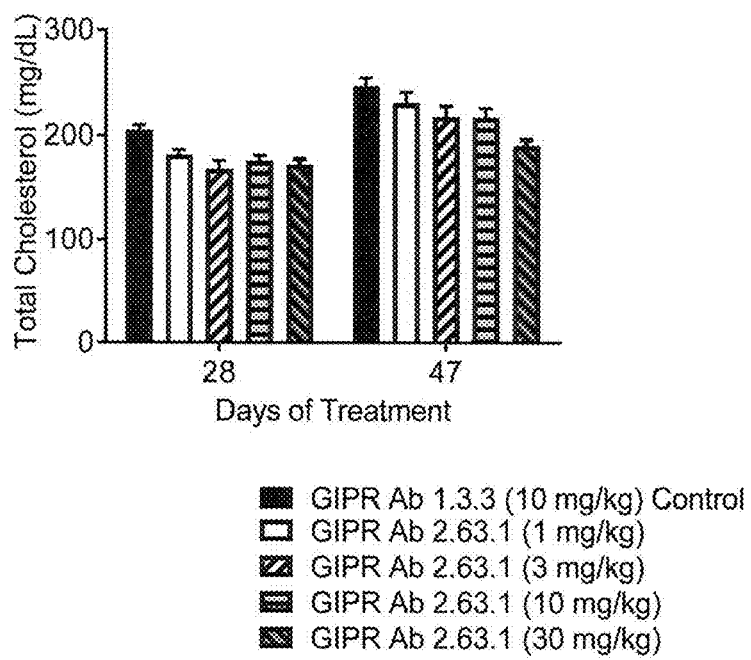
Figure 10B:
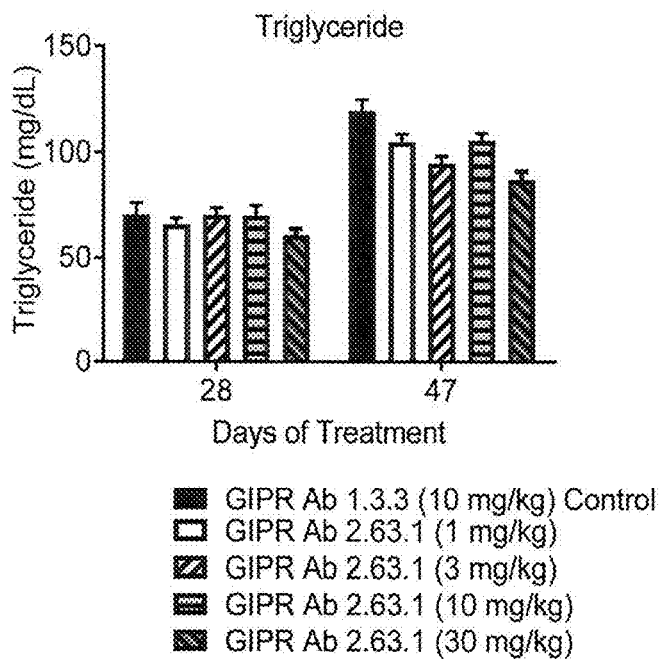
Figure 11:
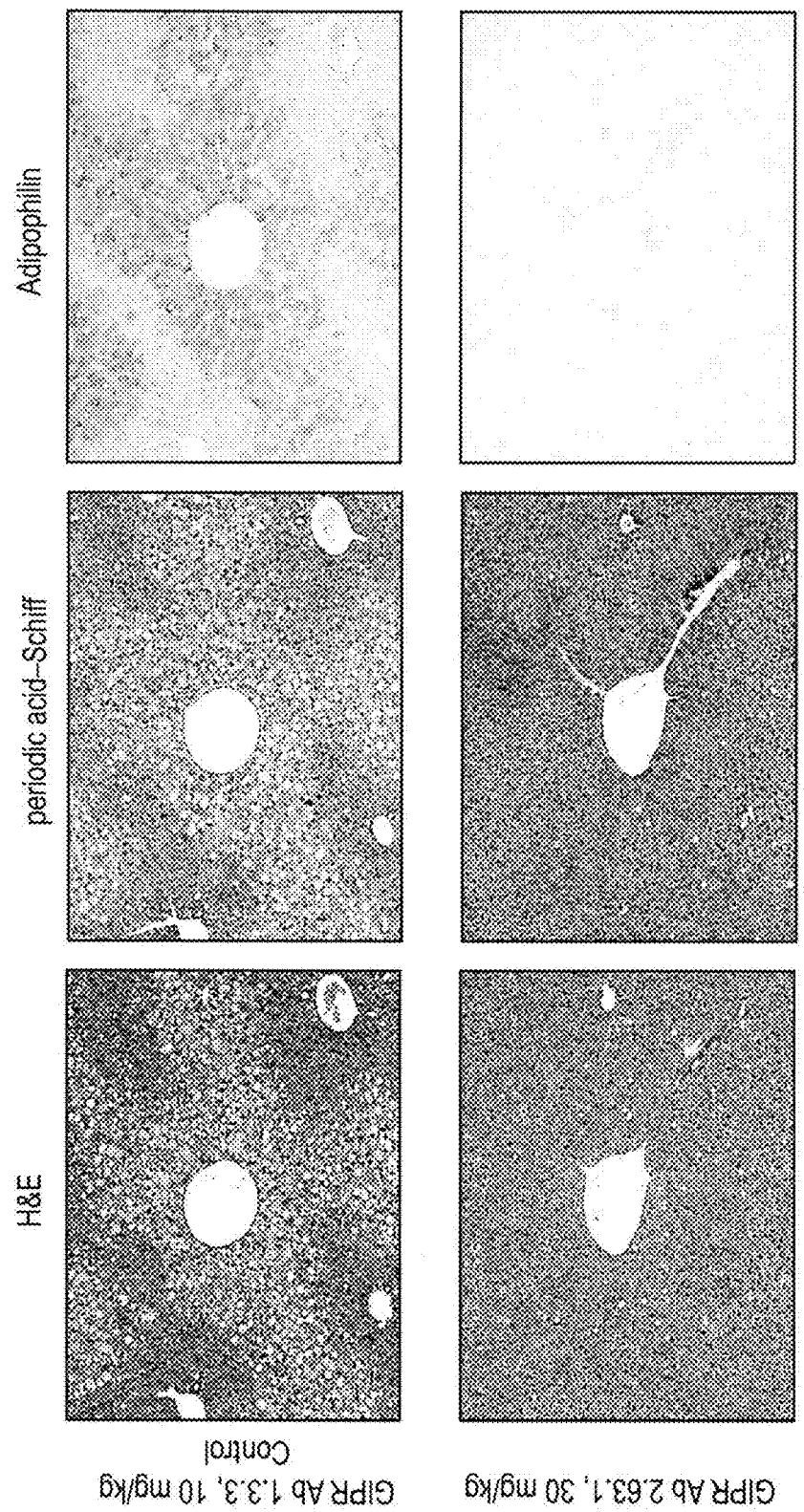
Figure 12A:
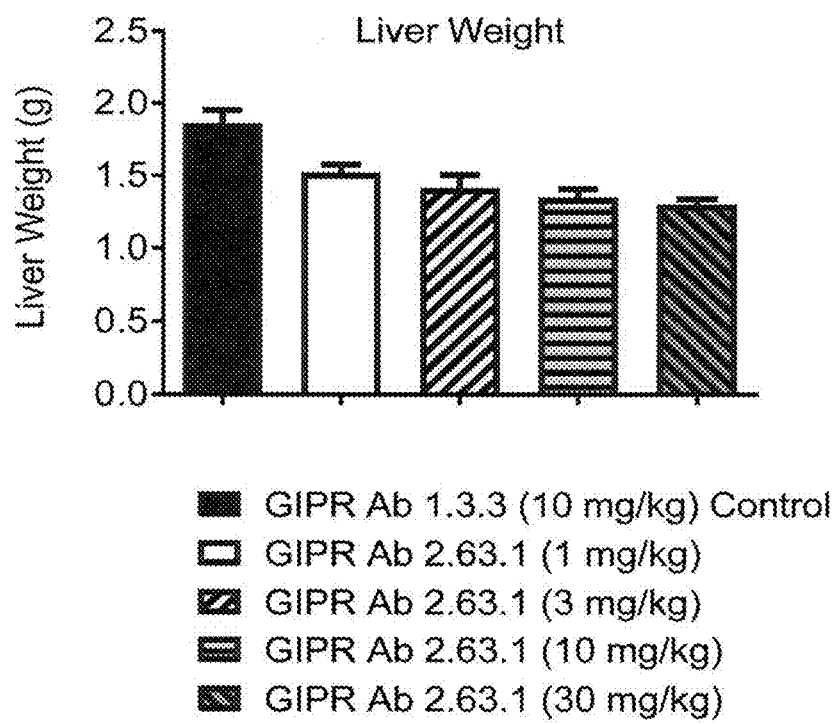
Figure 12B:
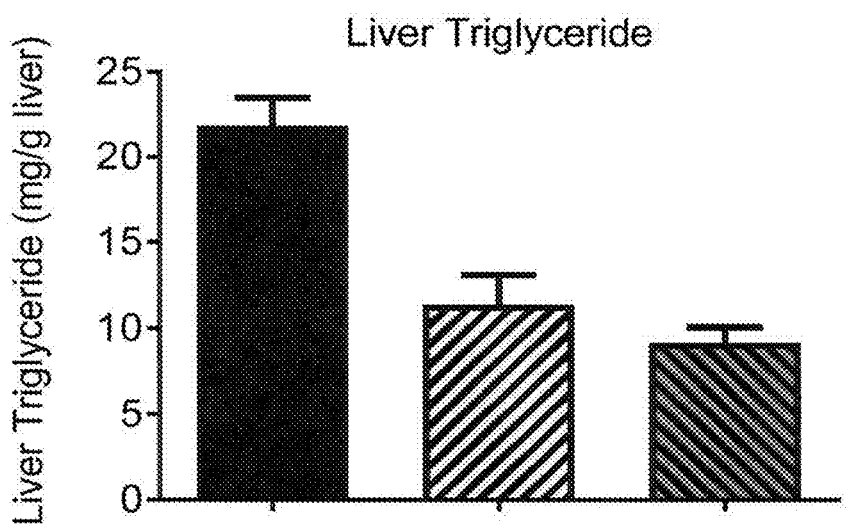
Figure 13:
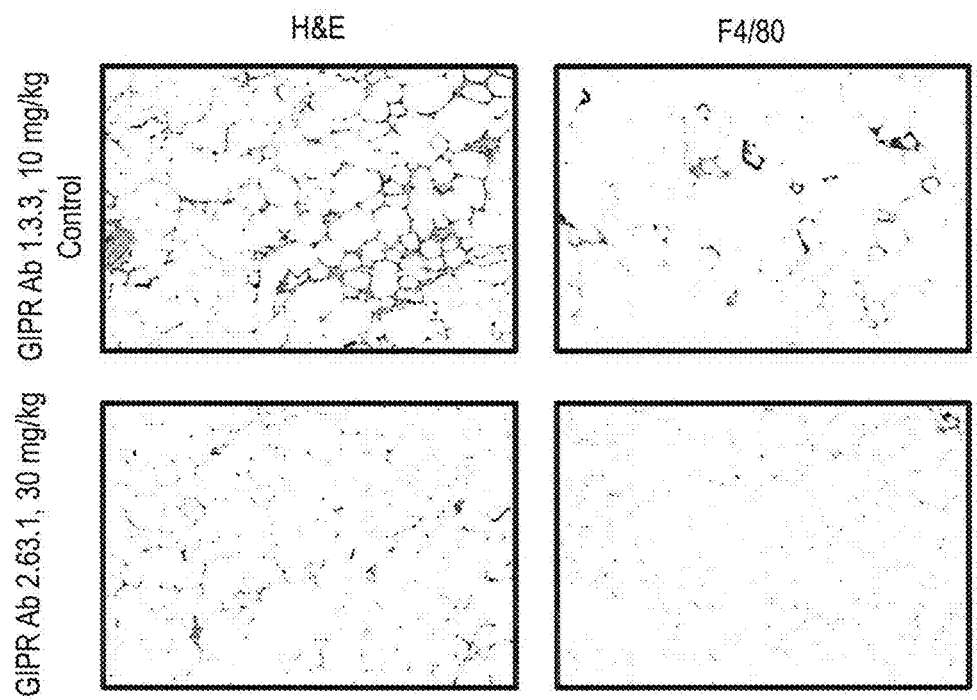

For intraperitoneal glucose tolerance test (IPGTT), mice were fasted for 4 hours. Glucose levels were measured and blood samples were taken from the tail vein before IPGTT was initiated. IPGTT was performed by intraperitoneal injection of glucose (1 g/kg body weight). Glucose levels were measured at 20, 40 and 60 minutes after glucose administration by using a glucose meter (Abbott). All data is presented in FIGS. 4-13. FIG. 4. GIPR Antibody 2.63.1 Results In Reduced Body Weight Gain FIG. 5 shows that treatment with anti-murine GIPR antibody 2.63.1 results in lower fat mass. FIG. 6 shows that treatment with anti-murine GIPR Antibody 2.63.1 results in lower epididymal white adipose tissue weights. FIG. 7 shows that treatment with anti-murine GIPR antibody 2.63.1 results in lower fasting glucose levels. FIG. 8 shows that treatment with anti-murine GIPR antibody 2.63.1 results in lower insulin levels. FIG. 9 shows that treatment with anti-murine GIPR antibody 2.63.1 results in improved glucose tolerance. FIG. 10 shows that treatment with anti-murine GIPR antibody 2.63.1 results in lower serum total cholesterol. FIG. 11 shows that treatment with anti-murine GIPR antibody 2.63.1 results in a reduction in hepatocyte microvesicular change and corresponding lipid accumulation. FIG. 12 shows that treatment with anti-murine GIPR antibody 2.63.1 results in reduced liver weight and triglyceride content. FIG. 13 demonstrates reduced inflammation and reduced infiltrating macrophages cells surrounding adipocytes in epididymal white adipose tissue with anti-murine GIPR antibody 2.63.1 treatment.

At termination, liver and epididymal fat was isolated and weighed using a balance. One piece of each tissue was fixed in 10% buffered formalin for 24 hours. Tissues were sectioned and stained as indicated in FIGS. 11 and 13.

EXAMPLE 4

Anti-GIPR Antibody Generation
Mouse Strains

Fully human antibodies to human GIPR were generated by immunizing XENOMOUSE® transgenic mice (U.S. Pat. Nos. 6,114,598; 6,162,963; 6,833,268; 7,049,426; 7,064,244, which are incorporated herein by references in their entirety; Green et al., 1994, Nature Genetics 7:13-21; Mendez et al., 1997, Nature Genetics 15:146-156; Green and Jakobovitis, 1998, J. Ex. Med, 188:483-495; Kellerman and Green, Current Opinion in Biotechnology 13, 593-597, 2002). Animals from the XMG2-K, XMG2-KL, XMG4-K and XMG4-KL XENOMOUSE® strains were used for all immunizations.

Immunizations

Multiple immunogens and routes of immunization were used to generate anti-human GIPR immune responses. For genetic immunizations, mice were immunized 12-14 times over 6-8 weeks using the Helios Gene Gun system according to the manufacturer's instructions (BioRad, Hercules, Calif.). Briefly, expression vectors encoding wild type human or rhesus GIPR were coated onto gold beads (Bio-Rad, Hercules, Calif.) and delivered to the epidermis of a shaved mouse or rat abdomen. For soluble protein immunizations, mice were immunized with a human GIPR recombinant protein representing the complete N-terminal extracellular domain (1-139). Animals were immunized with recombinant protein mixed with Alum and CpG-ODN 10 times over 4-6 weeks using sub-cutaneous injections. The initial boost was comprised of 10 µg while subsequent boosts contained 5-10 µg. GIPR-specific serum titers were monitored by live-cell FACS analysis on an Accuri flow cytometer (BD Biosciences) using transiently transfected 293T or stably transfected CHOs cells. Animals with the highest antigen-specific serum titers against human and rhesus GIPR were sacrificed and used for hybridoma generation (Kohler and Milstein, 1975).

Hybridoma Generation

Animals exhibiting suitable serum titers were identified and lymphocytes were obtained from spleen and/or draining lymphnodes. Pooled lymphocytes (from each immunization cohort) were dissociated from lymphoid tissue by grinding in a suitable medium (for example, Dulbecco's Modified Eagle Medium (DMEM); Invitrogen, Carlsbad, Calif.). B cells were selected and/or expanded using standard methods, and fused with a suitable fusion partner using techniques that were known in the art.

EXAMPLE 5

Binding Analysis for GIPR Engineering Panel and covariance ("CV") Fixes using MASS-1

MASS-1, sensor chip SPR Affinity Sensor—High Capacity Amine and amine coupling kit were from Sierra Sensors (Greenville, R.I.). Surfactant P-20, 10 mM sodium acetate, pH 4.0, and 10 mM glycine pH1.5 were from Biacore, Inc. (Piscataway, N.J.). Phosphate-buffered saline (PBS, 1×, no calcium chloride, no magnesium chloride) was from Gibco. Bovine serum albumin (BSA, fraction V, IgG free) was from Sigma. Goat-anti-huFc antibody was from Jackson ImmunoResearch Inc. (West Grove, Pa.).

Immobilization of goat-anti-huFc antibody to a sensor chip surface was performed according to manufacturer's instructions. Briefly, carboxyl groups on the sensor chip surfaces were activated by injecting 100 µL of a mixture containing 75 mg/mL N-ethyl-N'-(dimethylaminopropyl) carbodiimide (EDC) and 1.9 mg/mL N-hydroxysuccinimide (NHS) at 12.5 µL/min. Goat-anti-huFc antibody was diluted in 10 mM sodium acetate, pH 4.0 at 20 µg/mL and injected over the activated chip surfaces (flow cells channel 1-8/A&B) at 12.5 µL/min for 8 minutes. Excess reactive groups on the surfaces were deactivated by injecting 100 µL of 1 M ethanolamine. Final immobilized level was ~4000-5000 resonance units (RU).

Binding assays were carried out on the immobilized goat anti-huFc antibody surface by MASS-1. The experiment was performed at 25° C. The instrument running buffer was 0.005% P20/PBS. The goat anti-huFc capture antibody was covalently attached to the sensor chip surface via standard amine coupling to flow cells channel 1-8/A&B. The anti-huGIPR antibodies were diluted in sample buffer (0.1 mg/mL BSA, 0.005% P20, PBS) to 10 nM then captured to flow cells channel B. Channel A was as a blank reference surface without injection of anti-huGIPR antibody. The captured response range of channel B was ~100-400 RU. Then 200 nM huGIPR ECD was injected over the goat anti-huFc antibody captured anti-huGIPR antibody surfaces at flow rate 25 µL/min for 3 minutes. After a 6 minute dissociation, each surface was regenerated by injecting 10 mM Glycine, pH1.5 for 30 seconds. The sensorgrams were analyzed using MASS-1 software (AnalyserR2, version 0.1.6.5).

Each anti-huGIPR antibody sample was captured on a goat anti-huFc antibody coated MASS-1 sensor chip surface. 200 nM of huGIPR ECD was injected over captured sample surfaces. After a 6 minute dissociation, each surface was regenerated by injecting 10 mM Glycine, pH1.5. The resulting sensorgrams showed huGIPR ECD binding with anti-huGIPR antibody 6H1 family. See Table 8 and FIG. 15.

TABLE 8

The table summarizes the dissociation rate constant (kd) for the 6H1 family samples.

| Ab Name | iPS | Protein Lot | kd [1/s] |
| --- | --- | --- | --- |
| 21-143_6H1.005 | iPS:359879 | PL-42048 | 9.1E-04 |
| 21-143_6H1.006 | iPS:361069 | PL-42049 | 1.9E-04 |
| 21-143_6H1.007 | iPS:361073 | PL-42050 | 7.6E-04 |
| 21-143_6H1.008 | iPS:361077 | PL-42051 | 4.9E-04 |
| 21-143_6H1.009 | iPS:361853 | PL-42052 | 7.0E-04 |
| 21-143_6H1 | iPS:335940 | PL-42053 | 8.3E-04 |
| control 4B1.007 | iPS:336119 | PL-40272 | 1.4E-04 |

Figure 14A:
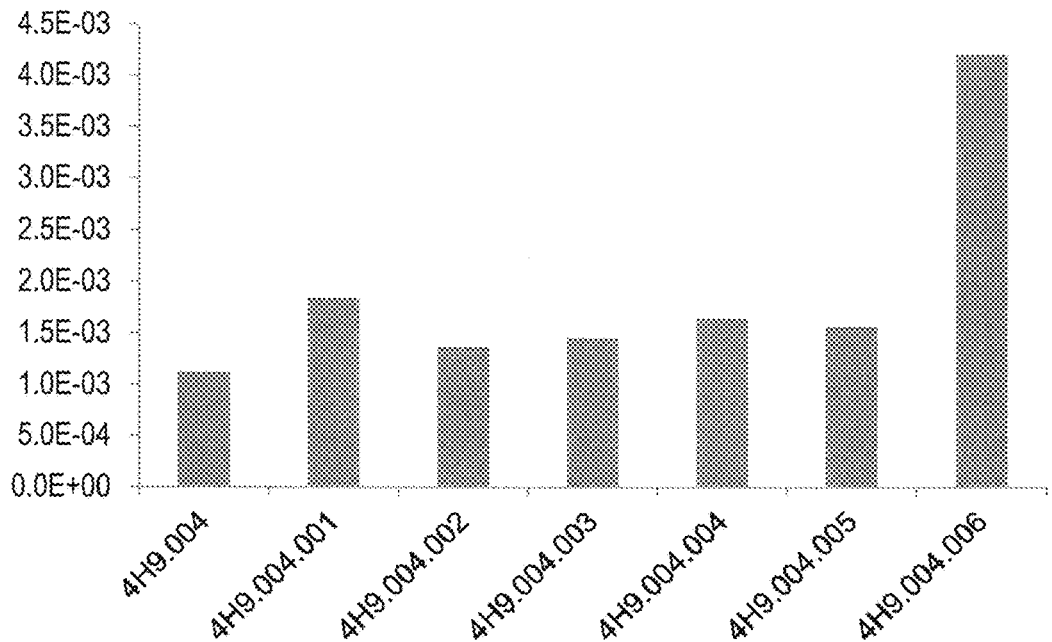
Figure 14B:
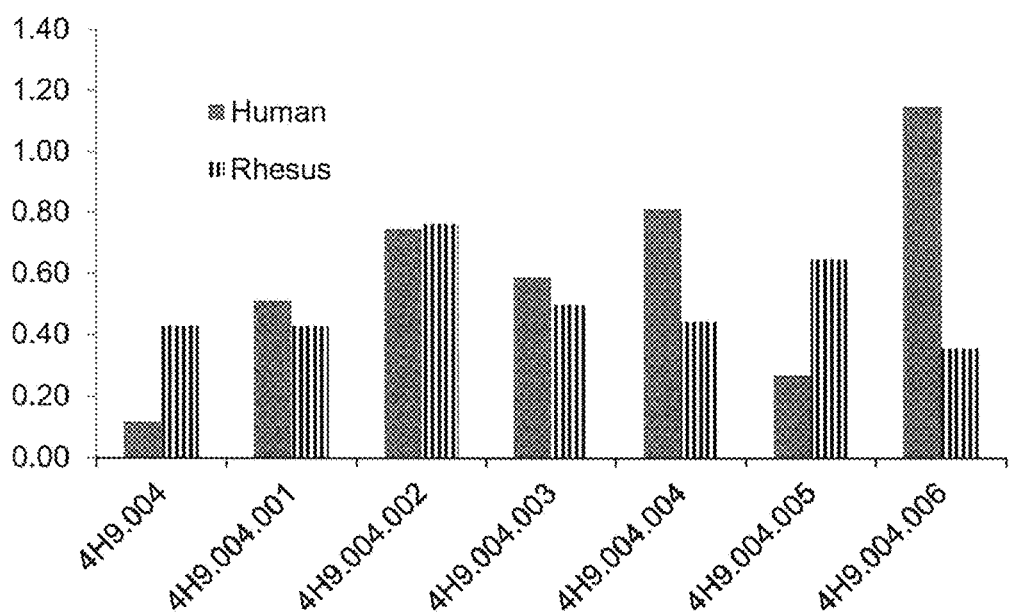
Figure 14C:
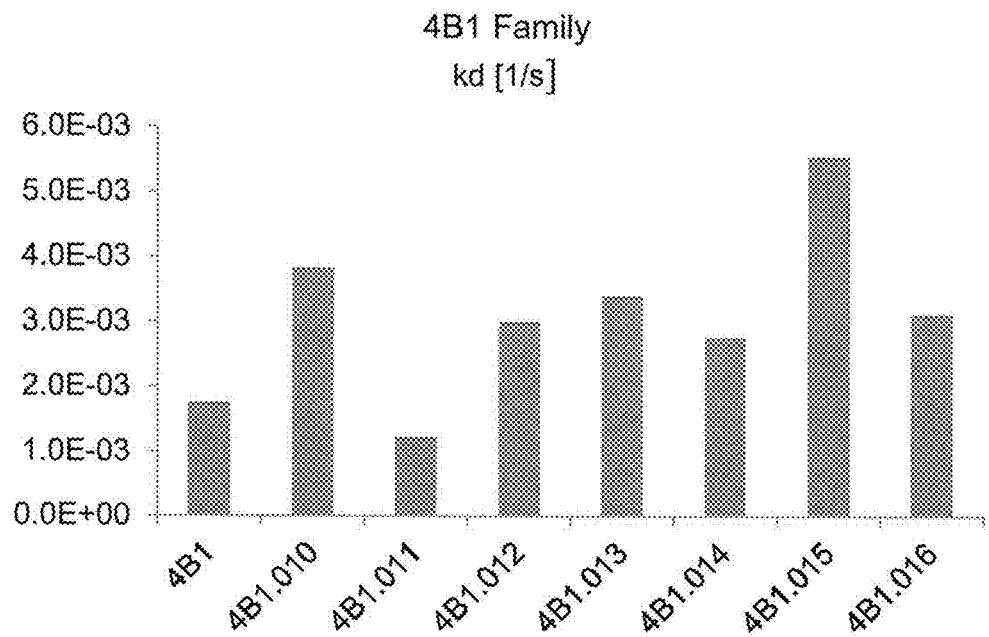
Figure 14D:
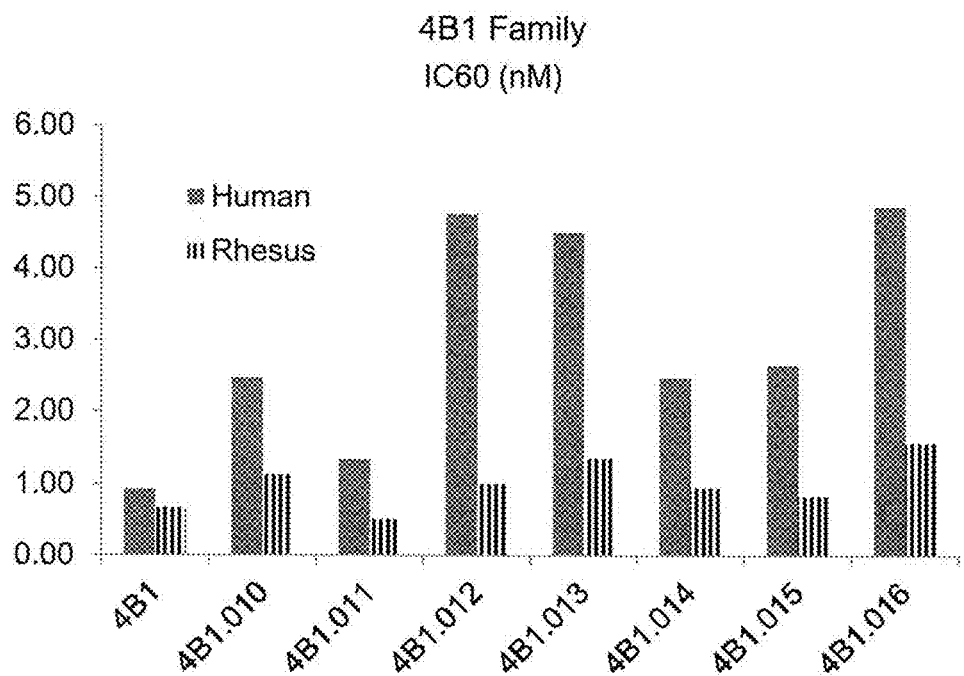
Figure 14E:
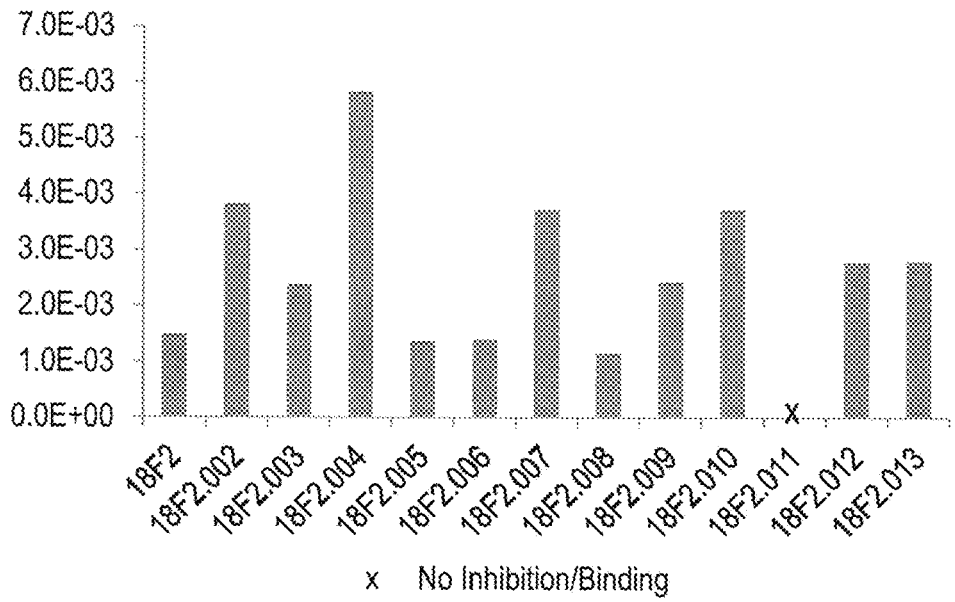
Figure 14F:
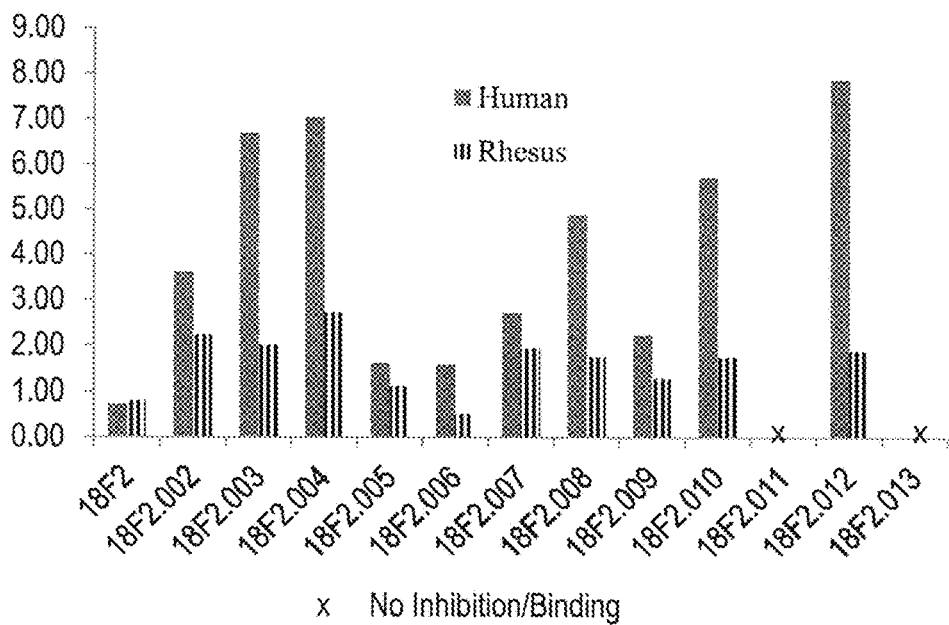
Figure 14G:
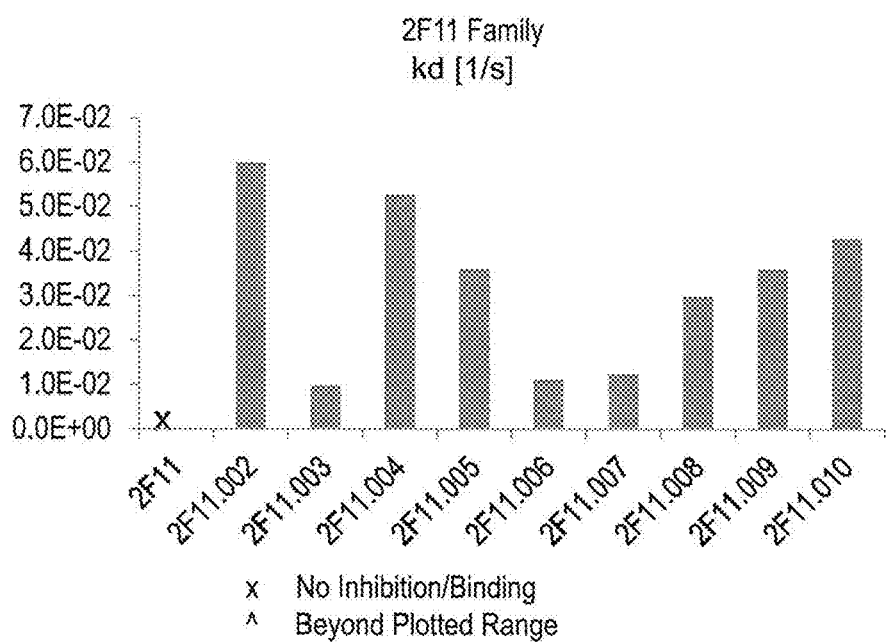
Figure 14H:
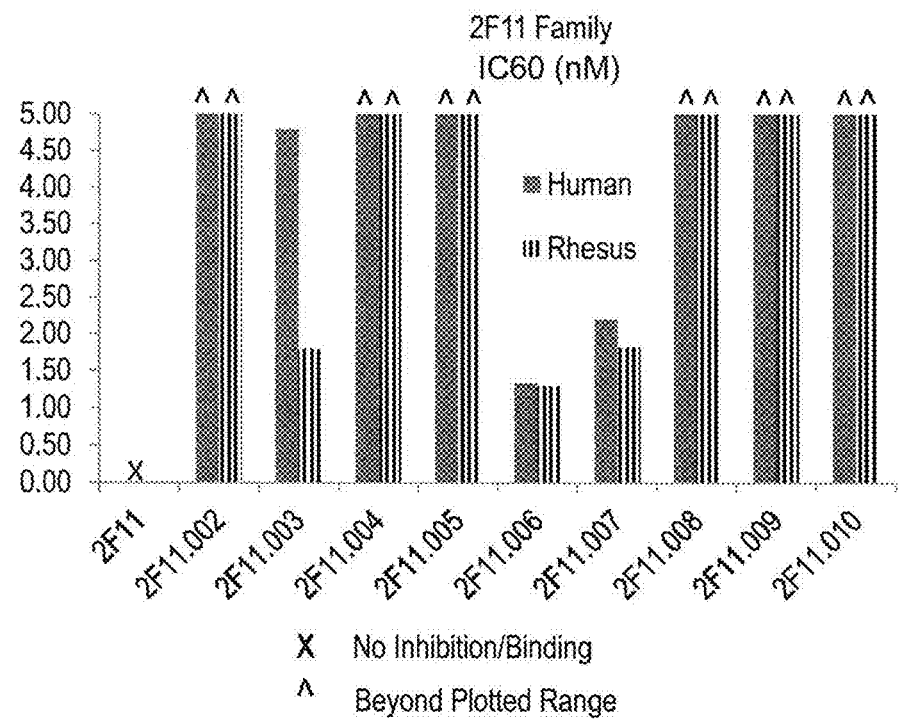
Figure 14I:
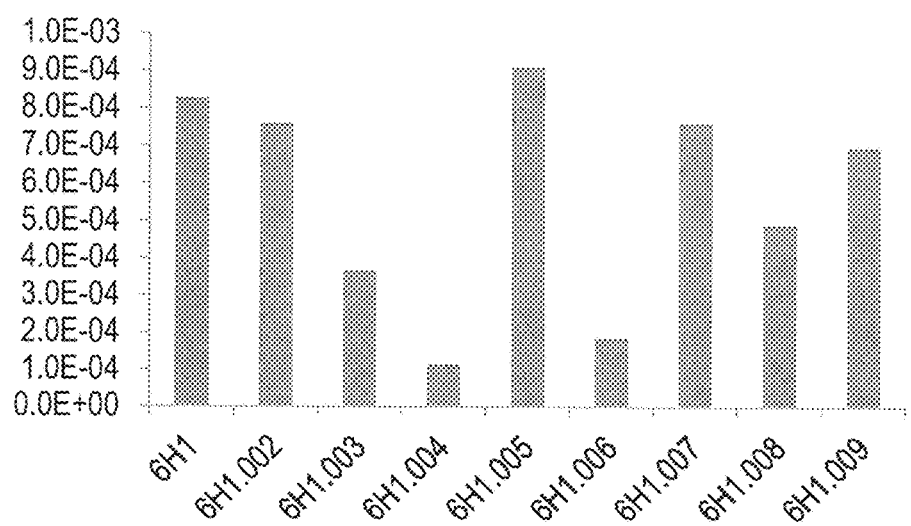
Figure 14J:
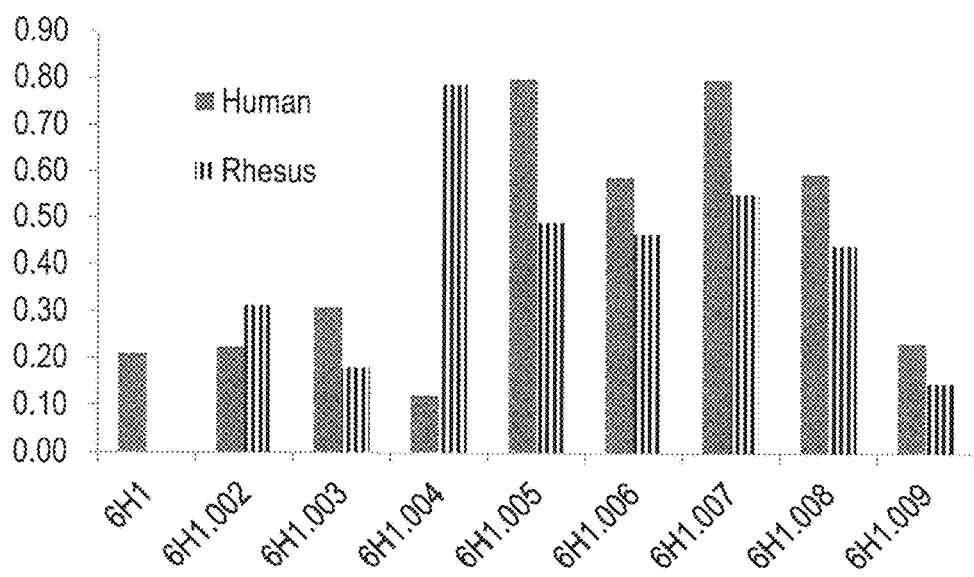
Figure 14K:
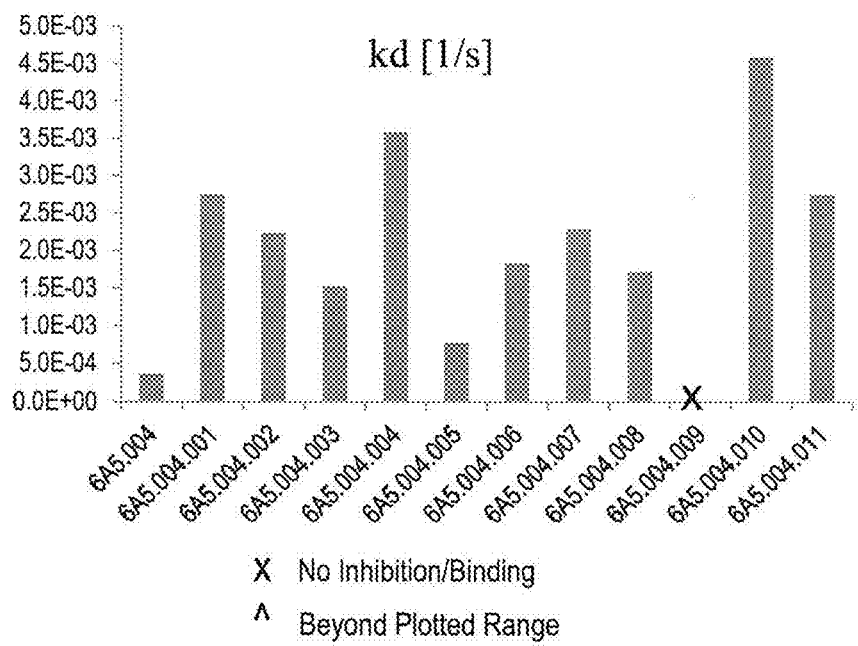
Figure 14L:
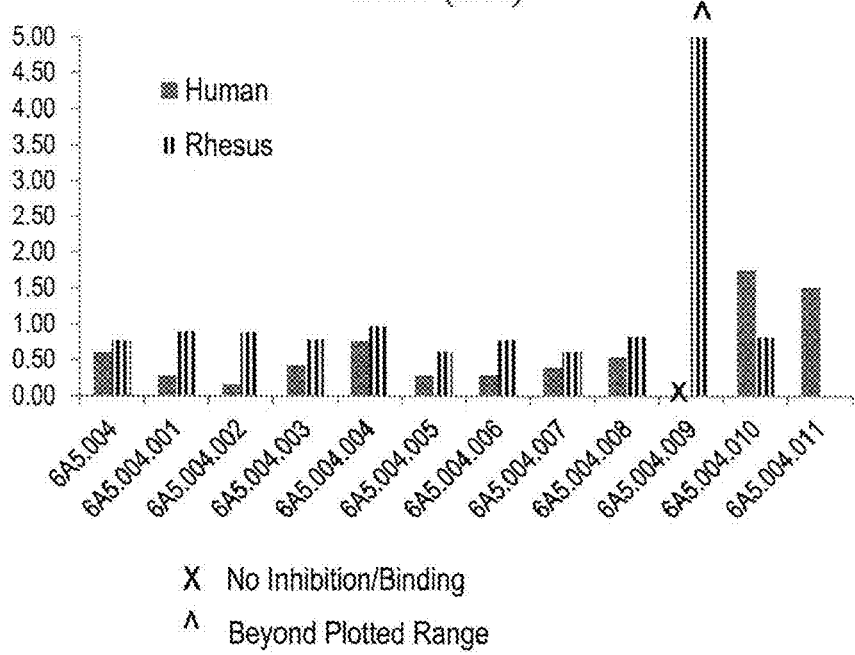
Figure 14M:
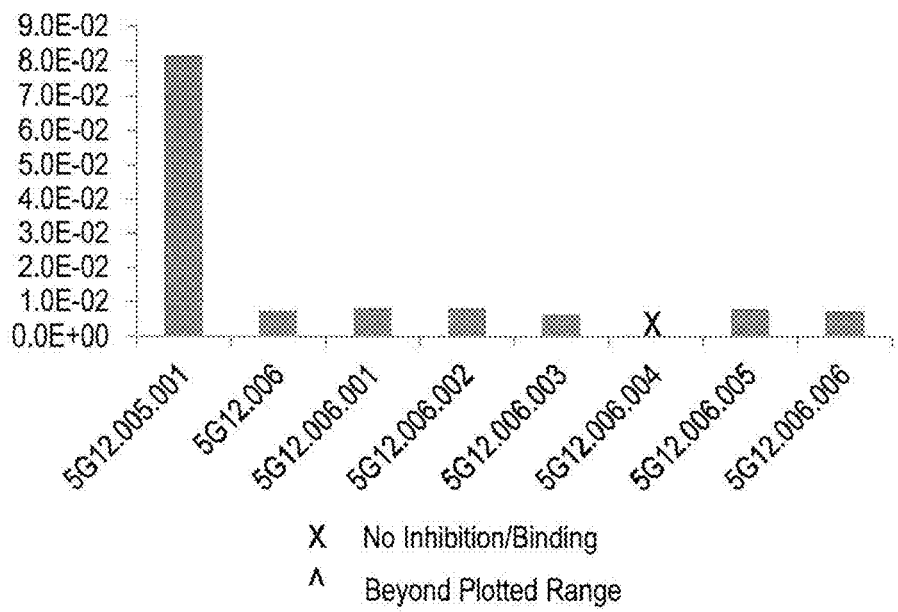
Figure 14N:
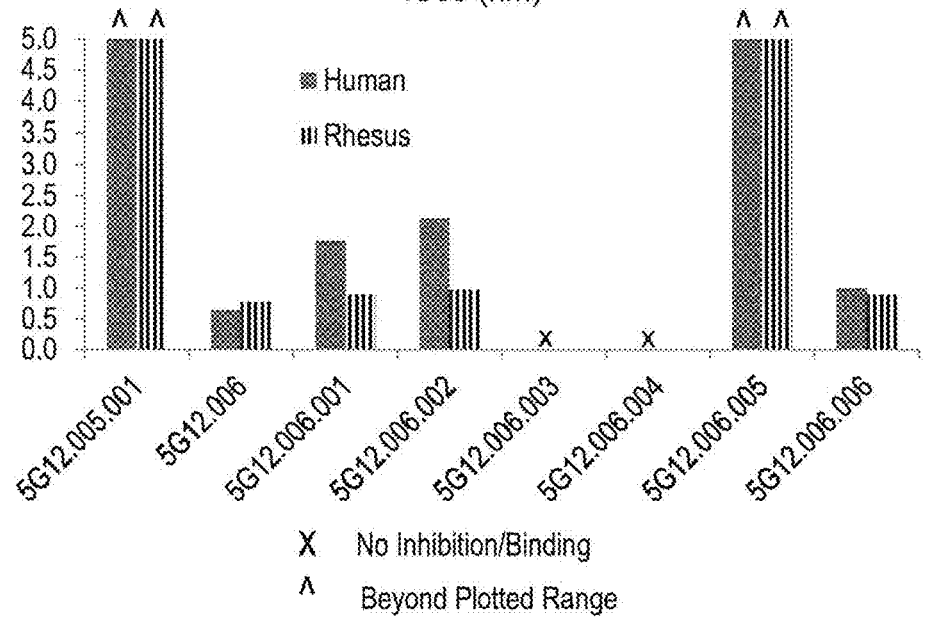
Figure 14O:
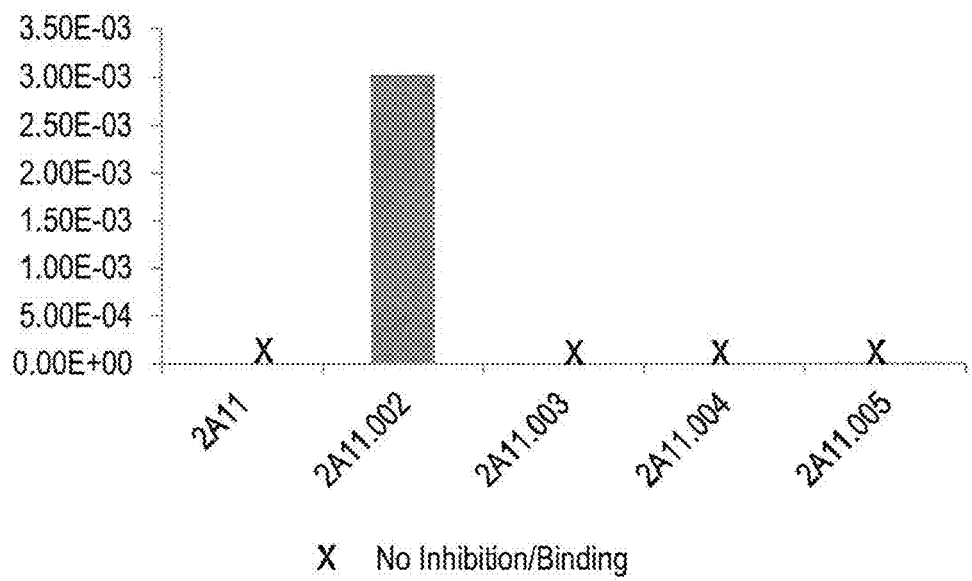
Figure 14P:
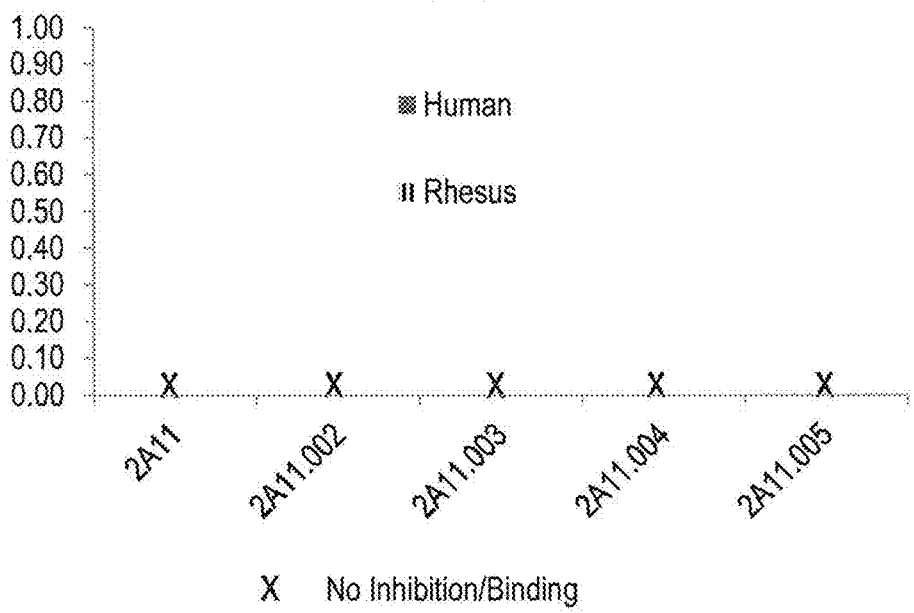
Figure 14Q:
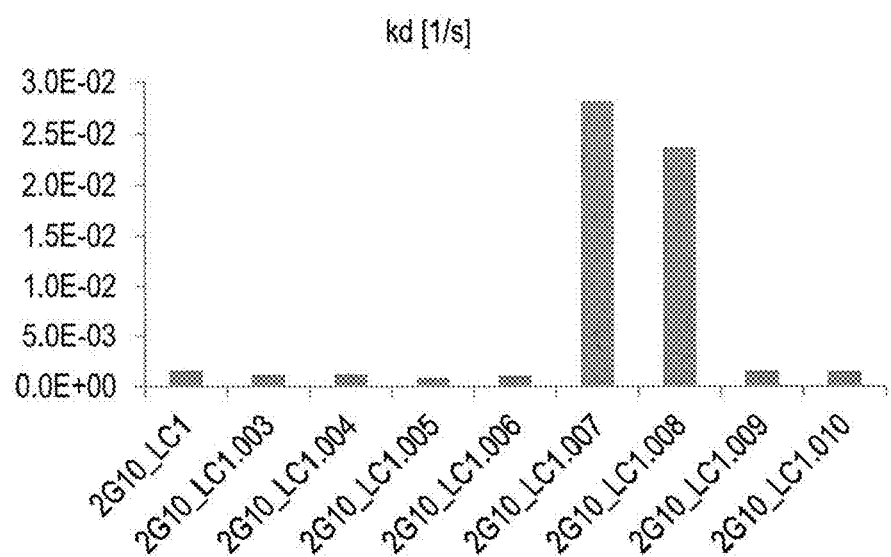
Figure 14R:
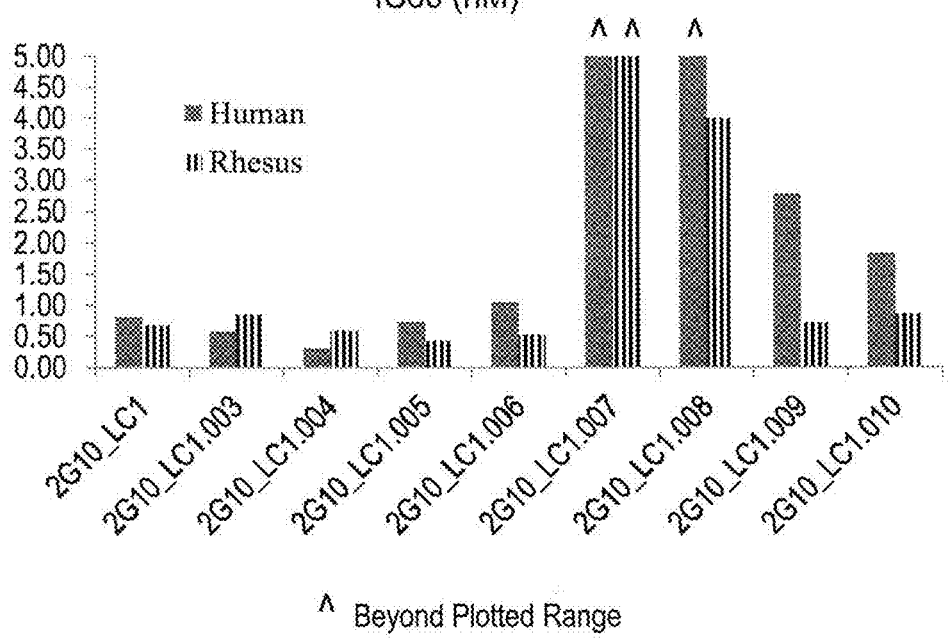
Figure 14S:
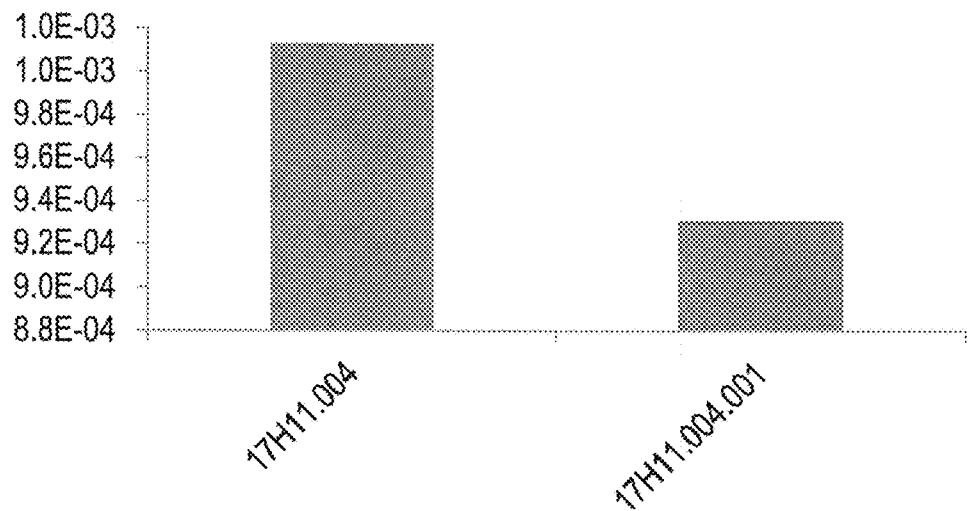
Figure 14T:
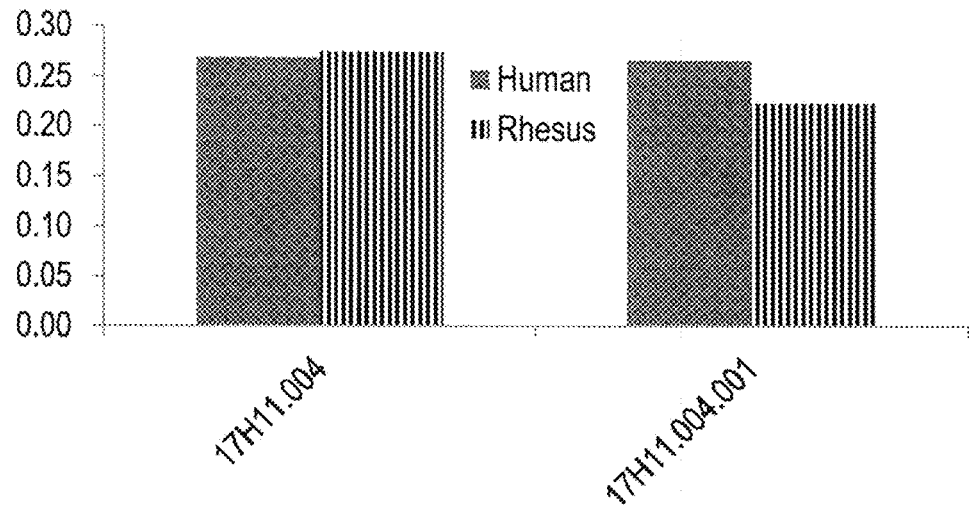
Figure 14U:
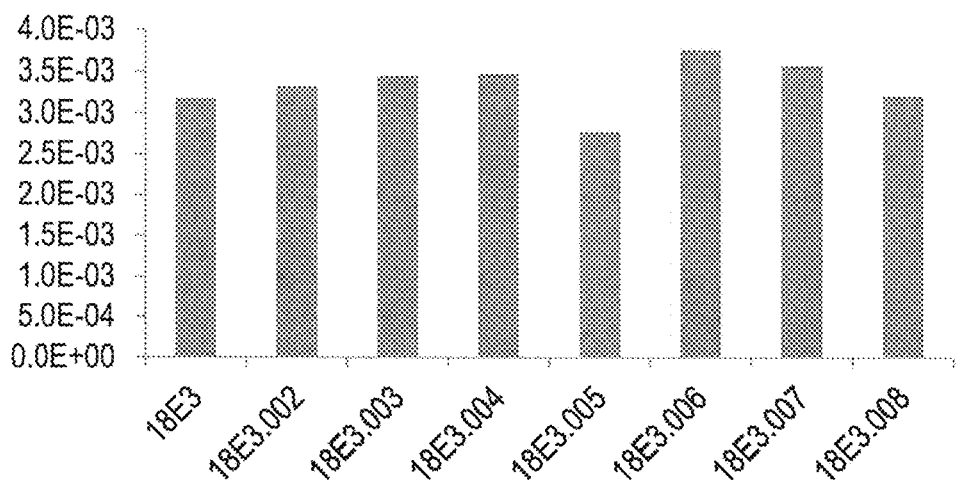
Figure 14V:
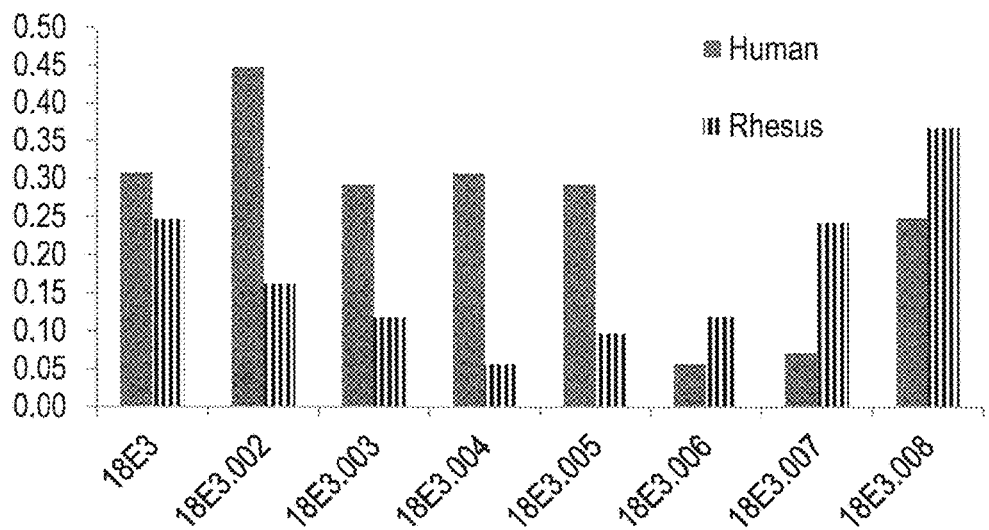
Figure 14W:
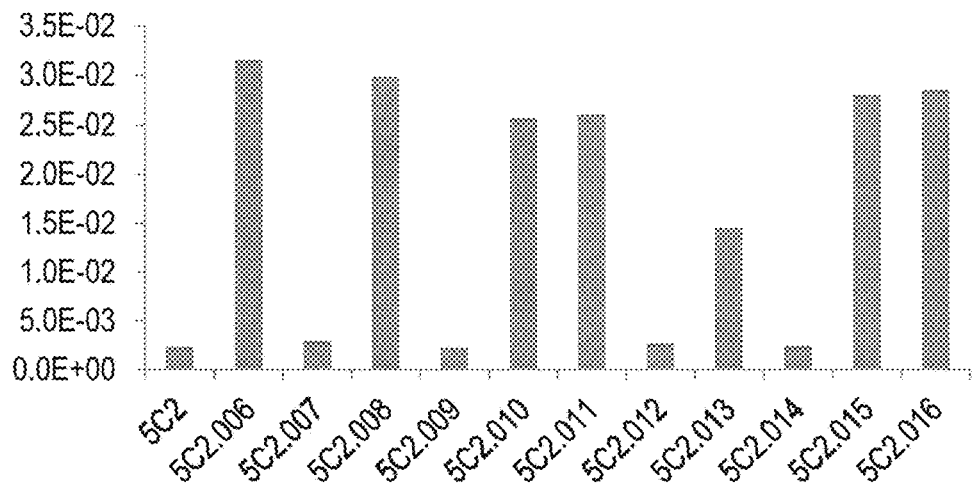
Figure 14X:
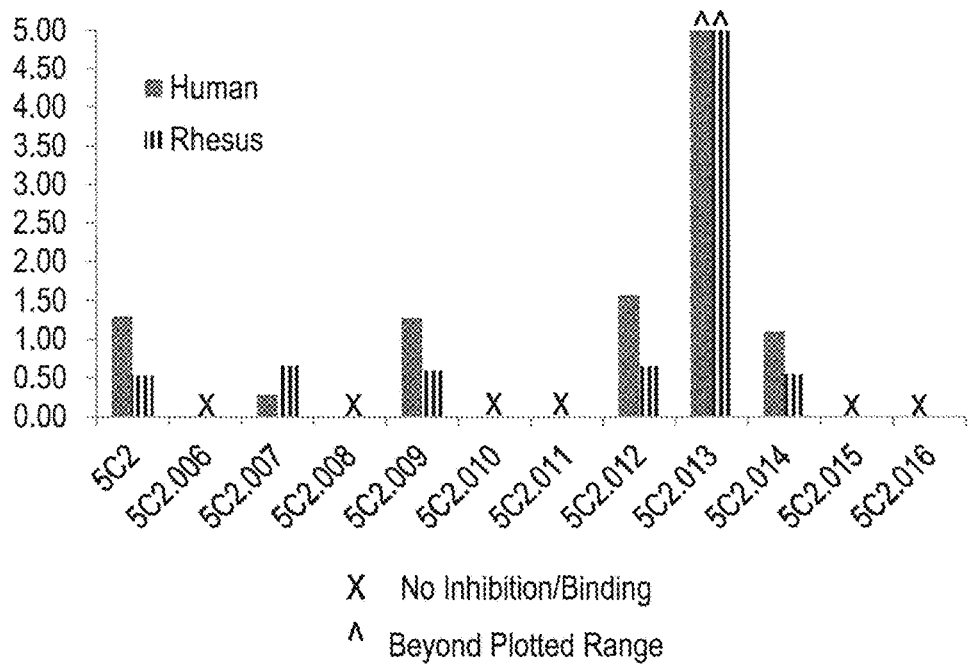
Figure 14Y:
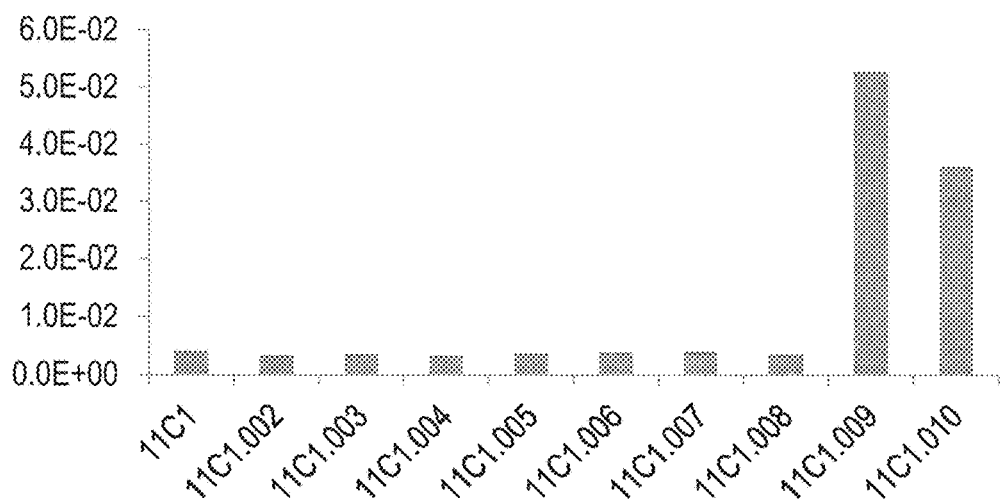
Figure 14Z:
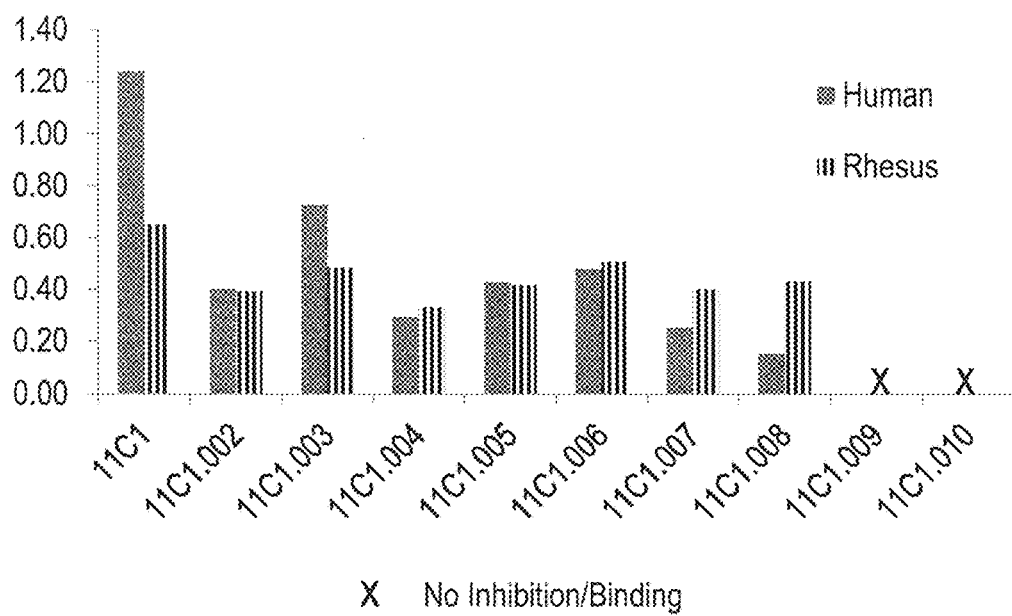
Figure 14A:
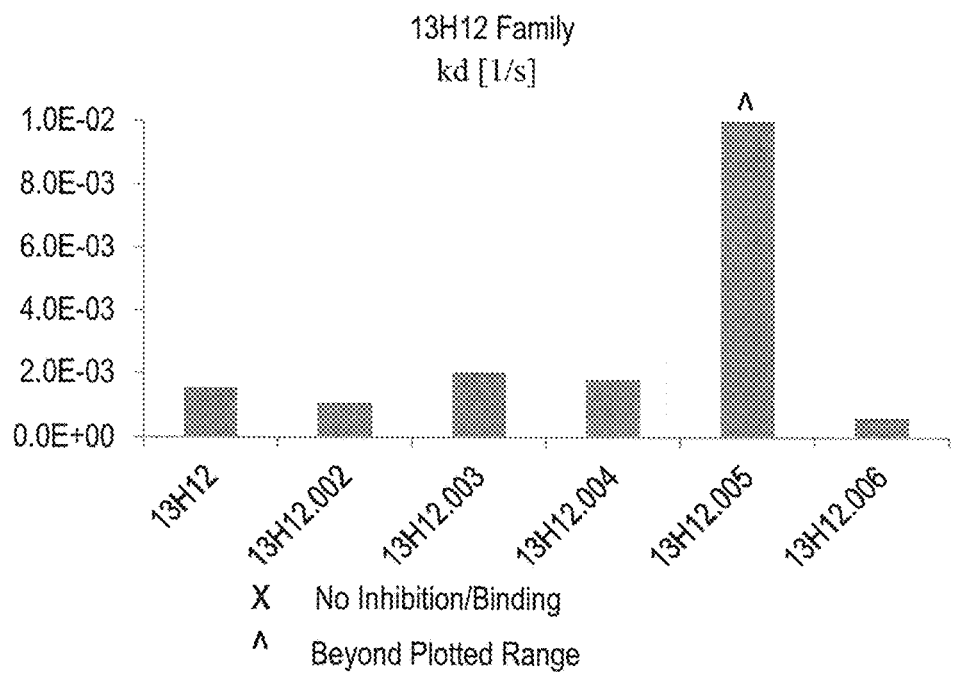
Figure 14B:
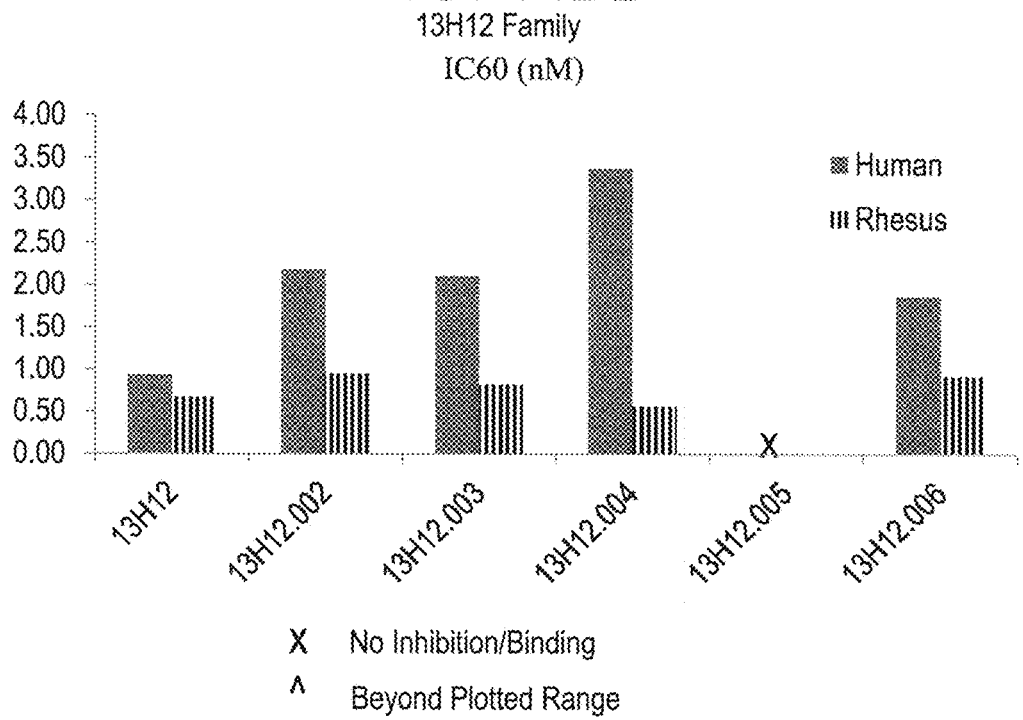
Figure 14C:
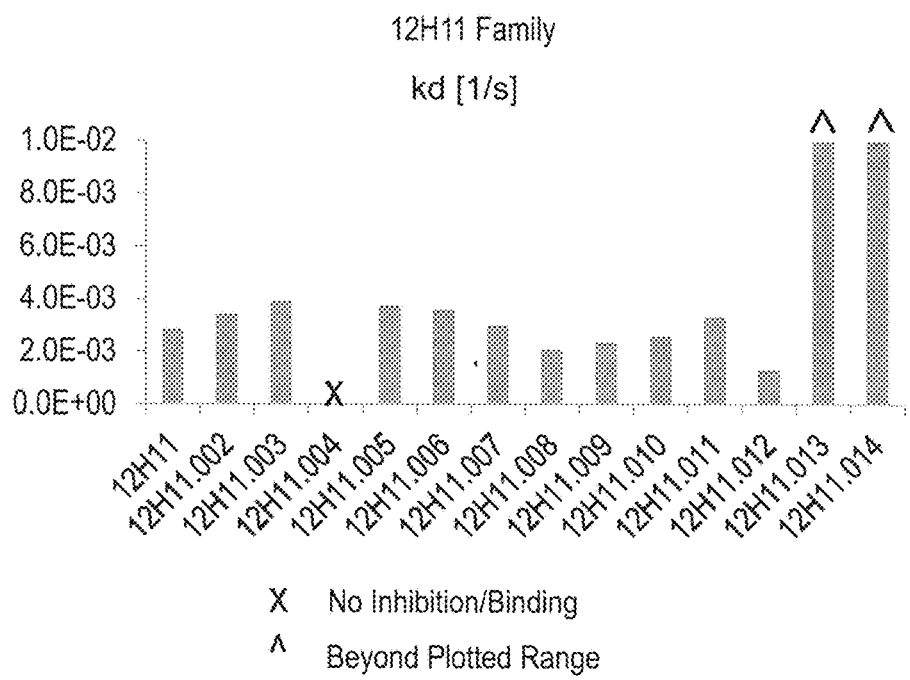
Figure 14D:
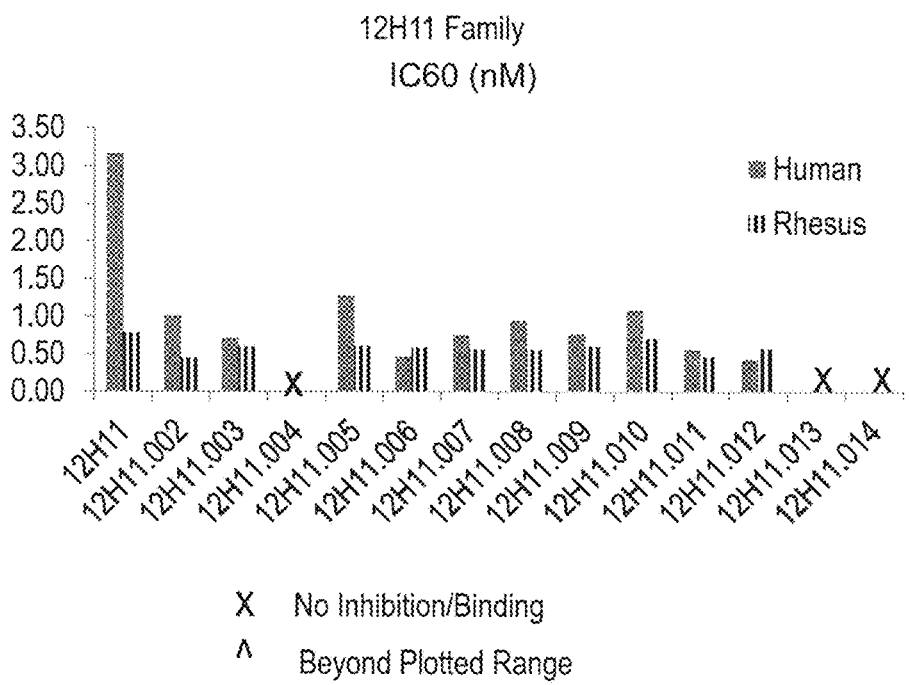
Figure 14E:
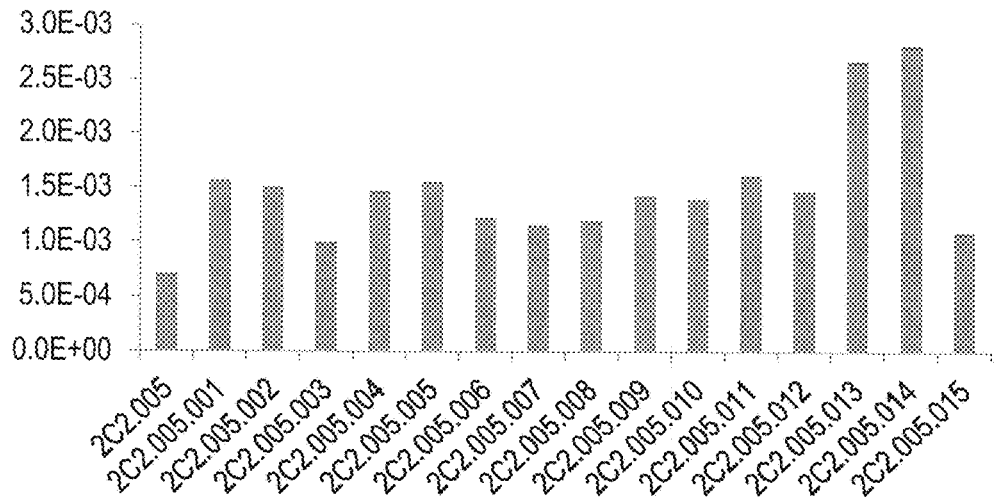
Figure 14F:
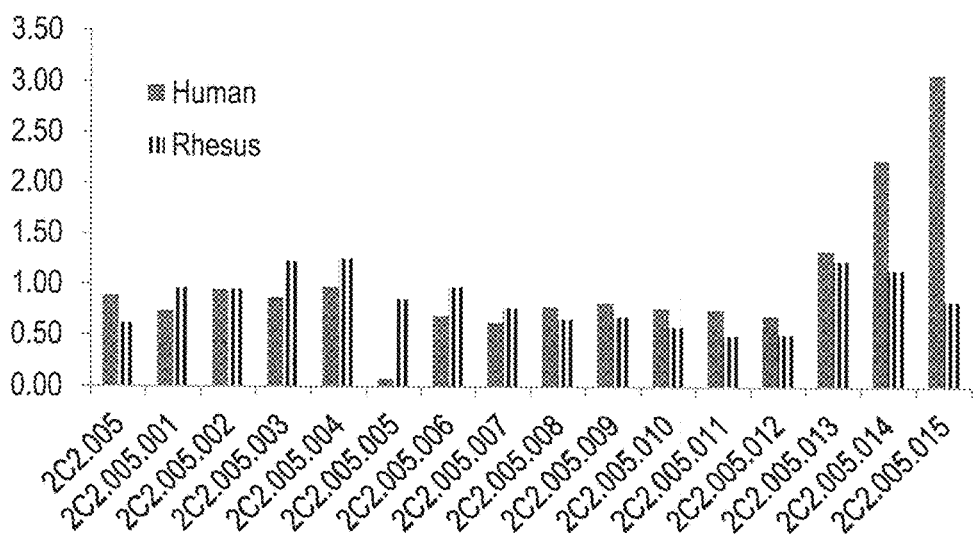
Figure 14G:
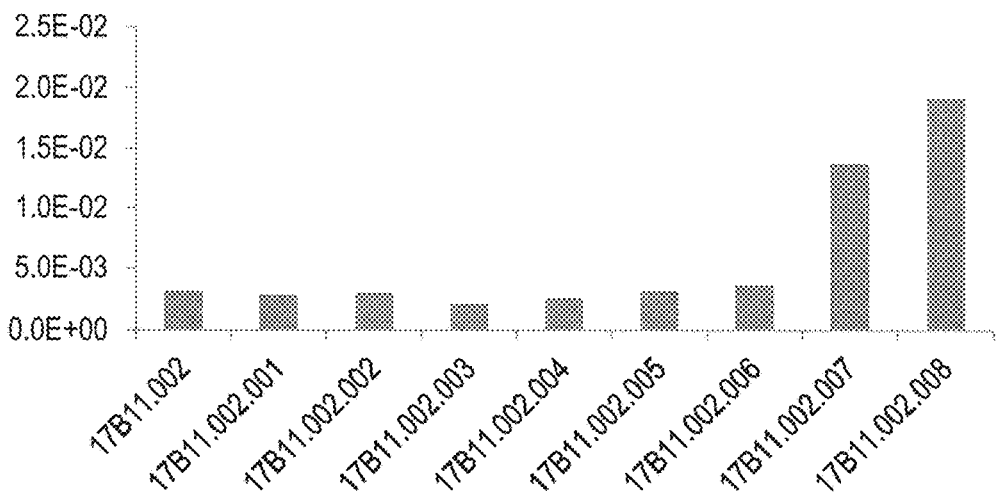
Figure 14H:
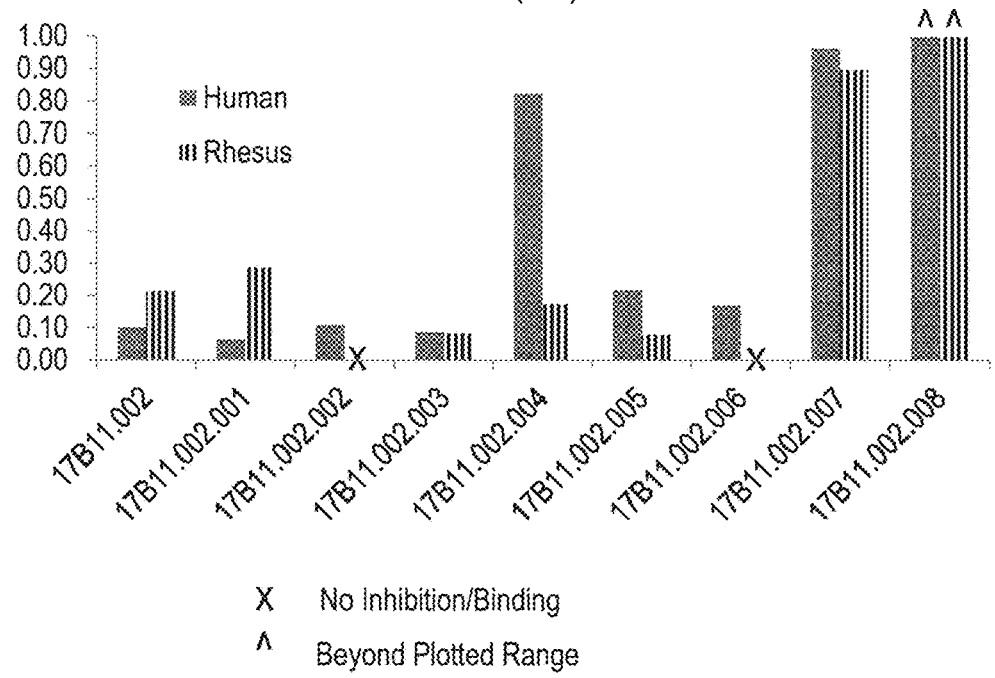
Figure 15:
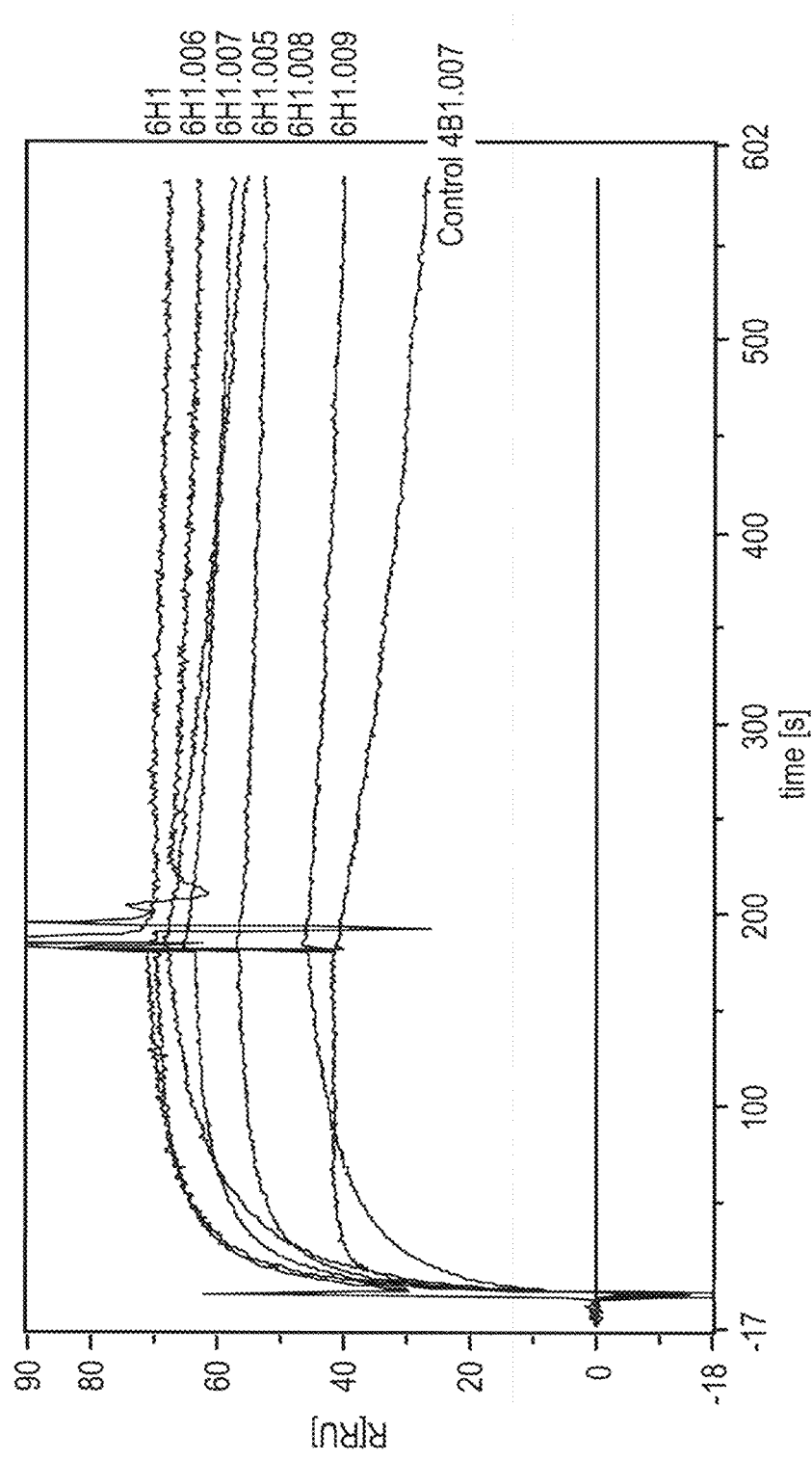
FIG. 15. 16H1 Family Binding to huGIPR ECD. 200 nM huGIPR ECD binding to goat anti-huFc antibody captured anti-huGIPR antibody 6H1 family.

The sensorgrams were analyzed using MASS-1 software (AnalyserR2, version 0.1.6.5). The graph summarizes the calculated dissociation rate constant (1/s) for the tested samples binding with huGIPR ECD. Results are shown in FIG. 14A-14Q and FIG. 15.

EXAMPLE 6

Description of Biological Assay used to Characterize Potency of Lead Panel

A cyclic AMP assay (no. 62AM4PEC CISBIO) was used to determine the potency of anti-GIPR antibodies. 293T cells were grown in suspension and transiently transfected with human GIPR using Lipofectamine 2000 (no. 11668027 Life Technologies). 24 hrs after transfection, antibody was titrated from high to low concentration in black 384 well plates (no. 3712 Corning Life Sciences) with a final volume of 10 uls/well in assay buffer (DMEM no. D5671 Sigma supplemented with 15 mM HEPES and 0.1% Bovine Serum Albumin). GIPR transfected cells were then added to the assay plate at 10,000 cells per well (10 uls/well) in the presence of 1:40 cAMP-d2 (CISBIO kit component). Assay plates were allowed to incubate for 30 minutes at 37' C., 5% CO2. A working stock of Human GIP (no. 027-02 Phoenix Pharmaceuticals) at 175 pM and 2.8 mM IBMX was prepared in assay buffer and 10 μls/well of this solution was added to assay plates. Plates were then incubated at 37° C., 5% CO2 for 30 minutes. Anti-cAMP-Eu3+-Cryptate (CISBIO kit component) was prepared at 1:40 in conjugate and lysis buffer (CISBIO kit component) and 15 uls/well of this solution was added to the assay plates and allowed to incubate for 1 hour at room temperature. Homogeneous time-resolved fluorescence was then collected on a Tecan Genios Pro multimode microplate reader using an excitation wavelength of 320 nM, a lag time of 150 is and an integration time of 50 us. Light emission was then detected at both 620 nM and 665 nM. Collected data was then reported as a FRET ratio of A665/A620 multiplied by a factor of 10000 as per CISBIO kit insert instructions. Percent inhibition of hGIP binding to transiently expressed GIPR was calculated by subtracting FRET ratio of cells plus hGIP (f1) from FRET ratio of cells plus antibody plus hGIP (f2) divided by FRET ratio of cells plus hGIP (f1) subtracted from FRET ratio of cells alone (f3) multiplied by 100: % Inhibition=[(f2−f1)/(f3−f1)]×100. IC60 values are shown in FIGS. 14Q-14Q and cAMP results are shown in Table 9.

TABLE 9

| iPS | Construct | kd [1/s] | Hu GIPR cAMP Assay (Conc. mAb @ 60% Inhibition in nM) | Rhesus GIPR cAMP Assay (Conc. mAb @ 60% Inhibition in nM) |
|---|---|---|---|---|
| 1 | 4H9.004 | | | |
| iPS:336079 | 4H9.004 | 1.1E−03 | 0.12 | 0.43 |
| iPS:359783 | 4H9.004.001 | 1.8E−03 | 0.51 | 0.43 |
| iPS:360931 | 4H9.004.002 | 1.4E−03 | 0.75 | 0.76 |
| iPS:360938 | 4H9.004.003 | 1.5E−03 | 0.59 | 0.50 |
| iPS:360945 | 4H9.004.004 | 1.6E−03 | 0.81 | 0.44 |
| iPS:360951 | 4H9.004.005 | 1.6E−03 | 0.27 | 0.65 |
| iPS:359763 | 4H9.004.006 | 4.2E−03 | 1.15 | 0.35 |
| 2 | 4B1 | | | |
| iPS:335916 | 4B1 | 1.7E−03 | 0.93 | 0.67 |
| iPS:360957 | 4B1.010 | 3.8E−03 | 2.46 | 1.14 |
| iPS:360964 | 4B1.011 | 1.2E−03 | 1.34 | 0.51 |
| iPS:360970 | 4B1.012 | 3.0E−03 | 4.77 | 1.01 |
| iPS:360976 | 4B1.013 | 3.4E−03 | 4.50 | 1.35 |
| iPS:360980 | 4B1.014 | 2.8E−03 | 2.46 | 0.95 |
| iPS:359787 | 4B1.015 | 5.6E−03 | 2.65 | 0.84 |
| iPS:360984 | 4B1.016 | 3.1E−03 | 4.87 | 1.57 |
| 3 | 18F2 | | | |
| iPS:335924 | 18F2 | 1.5E−03 | 0.72 | 0.80 |
| iPS:360988 | 18F2.002 | 3.8E−03 | 3.59 | 2.23 |
| iPS:360997 | 18F2.003 | 2.4E−03 | 6.69 | 2.01 |
| iPS:361001 | 18F2.004 | 5.8E−03 | 7.04 | 2.72 |
| iPS:361007 | 18F2.005 | 1.4E−03 | 1.62 | 1.13 |
| iPS:361011 | 18F2.006 | 1.4E−03 | 1.59 | 0.52 |
| iPS:361015 | 18F2.007 | 3.7E−03 | 2.72 | 1.94 |
| iPS:361019 | 18F2.008 | 1.2E−03 | 4.89 | 1.76 |
| iPS:361023 | 18F2.009 | 2.4E−03 | 2.23 | 1.28 |
| iPS:361030 | 18F2.010 | 3.7E−03 | 5.73 | 1.75 |
| iPS:360537 | 18F2.011 | no binding | >[Ab] Tested | >[Ab] Tested |
| iPS:361037 | 18F2.012 | 2.8E−03 | 7.87 | 1.88 |
| iPS:361847 | 18F2.013 | 2.8E−03 | >[Ab] Tested | >[Ab] Tested |
| 4 | 2F11 | | | |
| iPS:335943 | 2F11 | no binding | >[Ab] Tested | >[Ab] Tested |
| iPS:359942 | 2F11.002 | 6.0E−02 | 103.22 | 39.97 |
| iPS:361041 | 2F11.003 | 9.8E−03 | 4.79 | 1.79 |
| iPS:361045 | 2F11.004 | 5.3E−02 | 108.57 | 35.51 |
| iPS:361051 | 2F11.005 | 3.6E−02 | 84.34 | 68.57 |
| iPS:361057 | 2F11.006 | 1.1E−02 | 1.33 | 1.30 |
| iPS:361061 | 2F11.007 | 1.2E−02 | 2.20 | 1.82 |
| iPS:361065 | 2F11.008 | 3.0E−02 | 153.65 | 57.35 |
| iPS:359951 | 2F11.009 | 3.6E−02 | 147.64 | 36.91 |
| iPS:359958 | 2F11.010 | 4.3E−02 | 15.94 | 8.24 |
| 5 | 6H1 | | | |
| iPS:335940 | 6H1 | 8.3E−04 | 0.21 | |
| iPS:359867 | 6H1.002 | 7.6E−04 | 0.22 | 0.31 |
| iPS:359871 | 6H1.003 | 3.7E−04 | 0.31 | 0.18 |
| iPS:359875 | 6H1.004 | 1.2E−04 | 0.12 | 0.79 |
| iPS:359879 | 6H1.005 | 9.1E−04 | 0.80 | 0.49 |
| iPS:361069 | 6H1.006 | 1.9E−04 | 0.59 | 0.47 |

TABLE 9-continued

| iPS | Construct | kd [1/s] | Hu GIPR cAMP Assay (Conc. mAb @ 60% Inhibition in nM) | Rhesus GIPR cAMP Assay (Conc. mAb @ 60% Inhibition in nM) |
|---|---|---|---|---|
| iPS:361073 | 6H1.007 | 7.6E−04 | 0.80 | 0.55 |
| iPS:361077 | 6H1.008 | 4.9E−04 | 0.60 | 0.44 |
| iPS:361853 | 6H1.009 | 7.0E−04 | 0.23 | 0.15 |
| 6 | 6A5 | | | |
| iPS:336090 | 6A5.004 | 3.6E−04 | 0.60 | 0.76 |
| iPS:361081 | 6A5.004.001 | 2.8E−03 | 0.27 | 0.90 |
| iPS:361087 | 6A5.004.002 | 2.2E−03 | 0.15 | 0.88 |
| iPS:361093 | 6A5.004.003 | 1.5E−03 | 0.42 | 0.78 |
| iPS:361097 | 6A5.004.004 | 3.6E−03 | 0.76 | 0.97 |
| iPS:361103 | 6A5.004.005 | 7.7E−04 | 0.28 | 0.62 |
| iPS:361107 | 6A5.004.006 | 1.8E−03 | 0.28 | 0.77 |
| iPS:361111 | 6A5.004.007 | 2.3E−03 | 0.39 | 0.61 |
| iPS:361115 | 6A5.004.008 | 1.7E−03 | 0.53 | 0.82 |
| iPS:361122 | 6A5.004.009 | no binding | >[Ab] Tested | 23.34 |
| iPS:359898 | 6A5.004.010 | 4.6E−03 | 1.75 | 0.81 |
| iPS:359892 | 6A5.004.011 | 2.7E−03 | 1.51 | |
| 7 | 5G12 | | | |
| iPS:362053 | 5G12.005.001 | 8.2E−02 | 15.1 | 10.9 |
| iPS:336069 | 5G12.006 | 7.3E−03 | 0.6 | 0.8 |
| iPS:361129 | 5G12.006.001 | 8.1E−03 | 1.8 | 0.9 |
| iPS:361138 | 5G12.006.002 | 8.1E−03 | 2.1 | 1.0 |
| iPS:361142 | 5G12.006.003 | 6.2E−03 | >[Ab] Tested | >[Ab] Tested |
| iPS:359921 | 5G12.006.004 | | no sample | no sample |
| iPS:361146 | 5G12.006.005 | 7.8E−03 | 26.1 | 5.3 |
| iPS:361153 | 5G12.006.006 | 7.2E−03 | 1.0 | 0.9 |
| 8 | 2A11 | | | |
| iPS:335959 | 2A11 | | no sample | no sample |
| iPS:359569 | 2A11.002 | 3.0E−03 | >[Ab] Tested | >[Ab] Tested |
| iPS:335967 | 2A11.003 | no binding | >[Ab] Tested | >[Ab] Tested |
| iPS:361160 | 2A11.004 | no binding | >[Ab] Tested | >[Ab] Tested |
| iPS:361167 | 2A11.005 | no binding | >[Ab] Tested | >[Ab] Tested |
| 9 | 2G10_LC1 | | | |
| iPS:336043 | 2G10_LC1 | 1.6E−03 | 0.80 | 0.67 |
| iPS:361174 | 2G10_LC1.003 | 1.1E−03 | 0.57 | 0.85 |
| iPS:361180 | 2G10_LC1.004 | 1.2E−03 | 0.31 | 0.58 |
| iPS:361187 | 2G10_LC1.005 | 8.5E−04 | 0.72 | 0.43 |
| iPS:361194 | 2G10_LC1.006 | 1.0E−03 | 1.04 | 0.52 |
| iPS:359611 | 2G10_LC1.007 | 2.8E−02 | 68.24 | 16.31 |
| iPS:359617 | 2G10_LC1.008 | 2.4E−02 | 11.93 | 4.00 |
| iPS:361198 | 2G10_LC1.009 | 1.5E−03 | 2.78 | 0.71 |
| iPS:361204 | 2G10_LC1.010 | 1.4E−03 | 1.83 | 0.86 |
| 10 | 17H11 | | | |
| iPS:336101 | 17H11.004 | 1.0E−03 | 0.27 | 0.27 |
| iPS:359623 | 17H11.004.001 | 9.3E−04 | 0.27 | 0.22 |
| 11 | 18E3 | | | |
| iPS:336026 | 18E3 | 3.2E−03 | 0.31 | 0.25 |
| iPS:359646 | 18E3.002 | 3.3E−03 | 0.45 | 0.16 |
| iPS:361208 | 18E3.003 | 3.4E−03 | 0.29 | 0.12 |
| iPS:359630 | 18E3.004 | 3.5E−03 | 0.31 | 0.06 |
| iPS:359639 | 18E3.005 | 2.8E−03 | 0.29 | 0.10 |
| iPS:361212 | 18E3.006 | 3.8E−03 | 0.06 | 0.12 |
| iPS:361216 | 18E3.007 | 3.6E−03 | 0.07 | 0.24 |
| iPS:361220 | 18E3.008 | 3.2E−03 | 0.25 | 0.37 |
| 12 | 5C2 | | | |
| iPS:335972 | 5C2 | 2.4E−03 | 1.30 | 0.53 |
| iPS:361224 | 5C2.006 | 3.2E−02 | >[Ab] Tested | >[Ab] Tested |
| iPS:361231 | 5C2.007 | 2.9E−03 | 0.28 | 0.66 |
| iPS:361238 | 5C2.008 | 3.0E−02 | >[Ab] Tested | >[Ab] Tested |
| iPS:359687 | 5C2.009 | 2.3E−03 | 1.27 | 0.60 |
| iPS:361242 | 5C2.010 | 2.6E−02 | >[Ab] Tested | >[Ab] Tested |
| iPS:361249 | 5C2.011 | 2.6E−02 | >[Ab] Tested | >[Ab] Tested |
| iPS:361256 | 5C2.012 | 2.7E−03 | 1.56 | 0.65 |
| iPS:361263 | 5C2.013 | 1.5E−02 | 12.01 | 7.02 |
| iPS:361270 | 5C2.014 | 2.5E−03 | 1.10 | 0.54 |
| iPS:359671 | 5C2.015 | 2.8E−02 | >[Ab] Tested | >[Ab] Tested |
| iPS:359680 | 5C2.016 | 2.9E−02 | >[Ab] Tested | >[Ab] Tested |
| 13 | 11C1 | | | |
| iPS:335988 | 11C1 | 4.3E−03 | 1.24 | 0.65 |
| iPS:361277 | 11C1.002 | 3.5E−03 | 0.40 | 0.39 |
| iPS:361284 | 11C1.003 | 3.7E−03 | 0.73 | 0.48 |
| iPS:361291 | 11C1.004 | 3.5E−03 | 0.29 | 0.33 |
| iPS:359714 | 11C1.005 | 3.9E−03 | 0.43 | 0.42 |
| iPS:361295 | 11C1.006 | 4.1E−03 | 0.48 | 0.51 |
| iPS:361299 | 11C1.007 | 4.1E−03 | 0.25 | 0.40 |
| iPS:361303 | 11C1.008 | 3.7E−03 | 0.15 | 0.43 |

TABLE 9-continued

| iPS | Construct | kd [1/s] | Hu GIPR cAMP Assay (Conc. mAb @ 60% Inhibition in nM) | Rhesus GIPR cAMP Assay (Conc. mAb @ 60% Inhibition in nM) |
|---|---|---|---|---|
| iPS:359705 | 11C1.009 | 5.3E−02 | >[Ab] Tested | >[Ab] Tested |
| iPS:361307 | 11C1.010 | 3.6E−02 | >[Ab] Tested | >[Ab] Tested |
| 14 | 13H12 | | | |
| iPS:335980 | 13H12 | 1.5E−03 | 0.93 | 0.67 |
| iPS:361314 | 13H12.002 | 1.1E−03 | 2.18 | 0.95 |
| iPS:359746 | 13H12.003 | 2.0E−03 | 2.11 | 0.83 |
| iPS:361321 | 13H12.004 | 1.8E−03 | 3.38 | 0.56 |
| iPS:359739 | 13H12.005 | 2.7E−02 | >[Ab] Tested | >[Ab] Tested |
| iPS:361328 | 13H12.006 | 6.3E−04 | 1.87 | 0.92 |
| 15 | 12H11 | | | |
| iPS:335996 | 12H11 | 2.9E−03 | 3.17 | 0.79 |
| iPS:361332 | 12H11.002 | 3.4E−03 | 1.01 | 0.45 |
| iPS:361339 | 12H11.003 | 3.9E−03 | 0.71 | 0.60 |
| iPS:361346 | 12H11.004 | | >[Ab] Tested | >[Ab] Tested |
| iPS:361353 | 12H11.005 | 3.8E−03 | 1.28 | 0.61 |
| iPS:361360 | 12H11.006 | 3.6E−03 | 0.47 | 0.59 |
| iPS:361367 | 12H11.007 | 3.0E−03 | 0.76 | 0.56 |
| iPS:361374 | 12H11.008 | 2.1E−03 | 0.95 | 0.56 |
| iPS:361381 | 12H11.009 | 2.4E−03 | 0.77 | 0.60 |
| iPS:361385 | 12H11.010 | 2.6E−03 | 1.09 | 0.71 |
| iPS:361389 | 12H11.011 | 3.3E−03 | 0.56 | 0.47 |
| iPS:361393 | 12H11.012 | 1.3E−03 | 0.43 | 0.57 |
| iPS:361397 | 12H11.013 | 3.7E−02 | >[Ab] Tested | >[Ab] Tested |
| iPS:361404 | 12H11.014 | 3.6E−02 | >[Ab] Tested | >[Ab] Tested |
| 16 | 2C2 | | | |
| iPS:336177 | 2C2.005 | 7.1E−04 | 0.89 | 0.61 |
| iPS:361408 | 2C2.005.001 | 1.6E−03 | 0.73 | 0.96 |
| iPS:361414 | 2C2.005.002 | 1.5E−03 | 0.94 | 0.95 |
| iPS:361420 | 2C2.005.003 | 1.0E−03 | 0.86 | 1.23 |
| iPS:361426 | 2C2.005.004 | 1.5E−03 | 0.97 | 1.26 |
| iPS:361432 | 2C2.005.005 | 1.6E−03 | 0.07 | 0.85 |
| iPS:361438 | 2C2.005.006 | 1.2E−03 | 0.69 | 0.97 |
| iPS:361444 | 2C2.005.007 | 1.2E−03 | 0.62 | 0.76 |
| iPS:361450 | 2C2.005.008 | 1.2E−03 | 0.78 | 0.65 |
| iPS:361456 | 2C2.005.009 | 1.4E−03 | 0.82 | 0.68 |
| iPS:361462 | 2C2.005.010 | 1.4E−03 | 0.76 | 0.58 |
| iPS:361468 | 2C2.005.011 | 1.6E−03 | 0.75 | 0.49 |
| iPS:361474 | 2C2.005.012 | 1.5E−03 | 0.69 | 0.50 |
| iPS:361480 | 2C2.005.013 | 2.7E−03 | 1.33 | 1.23 |
| iPS:361487 | 2C2.005.014 | 2.8E−03 | 2.23 | 1.14 |
| iPS:361857 | 2C2.005.015 | 1.1E−03 | 3.07 | 0.83 |
| 17 | 17B11 | | | |
| iPS:336171 | 17B11.002 | 3.1E−03 | <0.1 nM | 0.21 |
| iPS:361493 | 17B11.002.001 | 2.8E−03 | 0.06 | 0.29 |
| iPS:361501 | 17B11.002.002 | 3.0E−03 | 0.11 | 0.00 |
| iPS:361505 | 17B11.002.003 | 2.1E−03 | 0.09 | 0.08 |
| iPS:361509 | 17B11.002.004 | 2.6E−03 | 0.82 | 0.17 |
| iPS:361516 | 17B11.002.005 | 3.2E−03 | 0.22 | 0.08 |
| iPS:360584 | 17B11.002.006 | 3.6E−03 | 0.17 | 0.00 |
| iPS:361520 | 17B11.002.007 | 1.4E−02 | 0.96 | 0.90 |
| iPS:360572 | 17B11.002.008 | 1.9E−02 | 6.37 | 7.89 |

EXAMPLE 7

Figure 16:
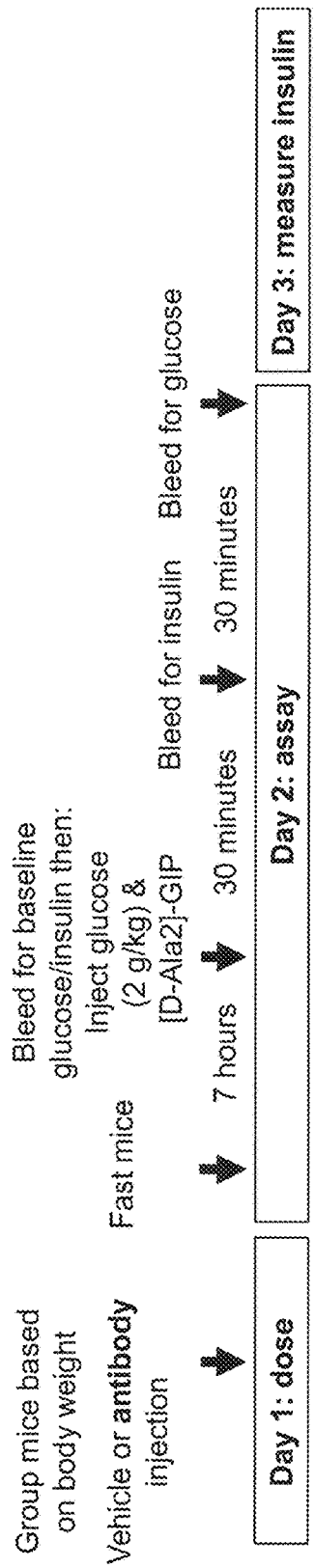
FIG. 16. Mouse Pharmacodynamic Assay To Test GIPR Antibodies—Study Design

FIG. 16 provides an overview of the mouse pharmacodynamic assay to test anti-GIPR Antibodies. Male C57BL/6 DIO mice at 16 weeks old were purchased from Jackson laboratory. After arrival, mice were single housed and continued on high fat diet (60 kcal % fat, Research diet) for 2 weeks before pharmacological study. Four days before the start of treatments, 4 h fasting glucose and insulin were measured. Body weight was recorded twice a week during the week before the treatments start and the day of start. The mice were randomized into groups and received one of the following treatments: (1) vehicle (10 mM acetate, 150 mM NaCl, pH 5.0), (2) 0.008 mg/kg 5G12.006, (3) 0.04 mg/kg 5G12.006, (4) 0.2 mg/kg 5G12.006, (5) 1 mg/kg 5G12.006, (6) 5 mg/kg 5G12.006. All treatments were administrated once a week intraperitoneally for four weeks. Body weight was measured twice a week. Results are shown in FIG. 17. Anti-GIPR antibody 5G12.006 binds to both murine and human GIPR.

EXAMPLE 8

The study design is outlined in FIG. 18. Male C57BL/6 Diet-Induced Obese mice (Jackson Lab), 18 weeks old at start (on high fat diet for 12 weeks) were randomized based on body weight. Mice were dosed each week for 4 weeks. Body weights were recorded twice a week; not fasted glucose measured on day 18 and fasted insulin measured on day 29. Terminal blood collected for measurement of total cholesterol, and triglycerides. Intraperitoneal glucose tolerance test (IPGTT) was performed on day 25 with 4 hour fast with 1 g/kg of glucose. After 4 weeks, study was terminated following a 4 hour fast. Serum samples were collected and livers were weighed. Blood was collected from tail vein or cardiac puncture at termination. Serum samples were obtained by centrifugation of blood collection tubes at 10000 rpm. Serum insulin levels were determined by using mouse high range insulin ELISA (ALPCO Diagnostics). The triglyceride levels were measured using an Infinity triglyceride assay kit (Thermo Scientific). Total cholesterol was measured using an Infinity total cholesterol kit (Thermo Scientific). At termination, liver and epididymal fat were isolated and weighed using a balance.

Figures 19A, 19B:
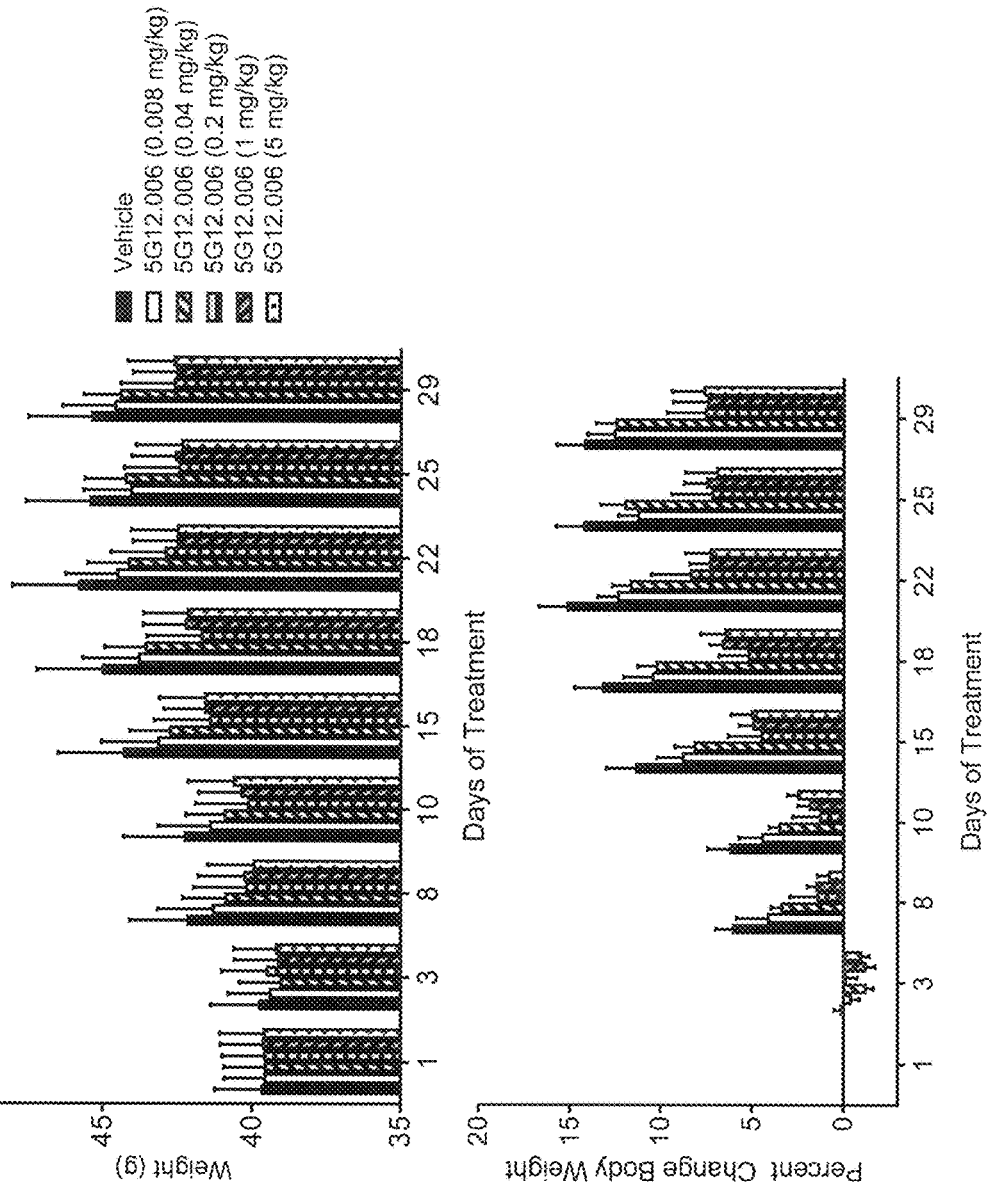
(FIG. 19A) weight (g) and (FIG. 19B) percent change body weight FIG. 20A-20B. GIPR Antibody 5G12.006 Results In Improved Glucose Tolerance as shown by (FIG. 20A) glucose levels and (FIG. 20B) AUC FIG. 21A-21B. GIPR Antibody 5G12.006 Results In (FIG. 21A) Lower Glucose and (FIG. 21B) Insulin Levels FIG. 22. GIPR Antibody 5G12.006 Results In Lower Liver Weights FIG. 23A-23B. GIPR Antibody 5G12.006 Results In Lower (FIG. 23A) Total Cholesterol Levels and (FIG. 23B) Triglyceride levels FIG. 24. Treatment Of Mice With Anti-GIPR 2.63.1 In Combination With Liraglutide—Study Design FIG. 25A-25B. Body Weight Loss In Mice Treated With Anti-GIPR 2.63.1 In Combination With Liraglutide.
Figure 20A:
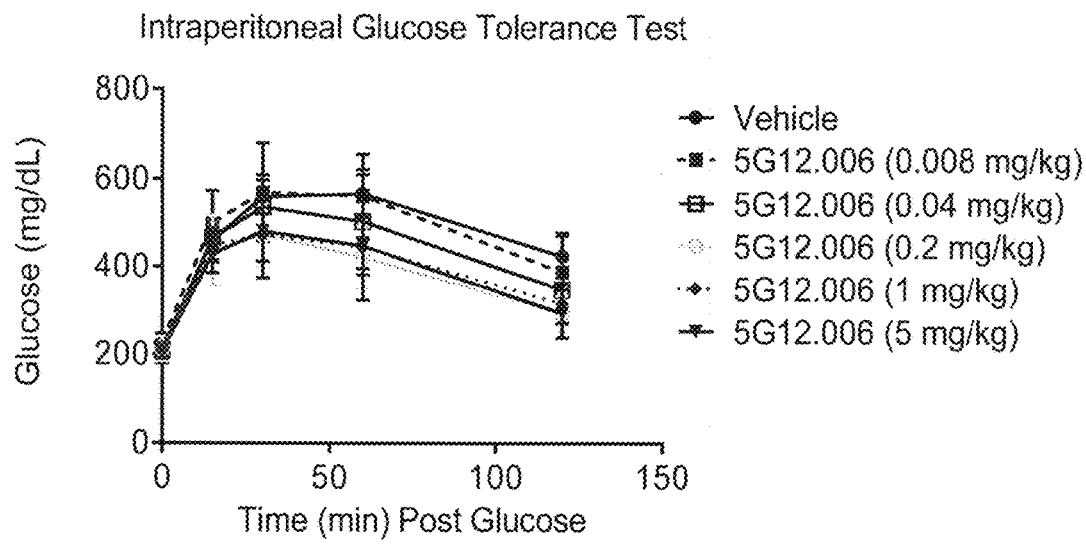
Figure 20B:
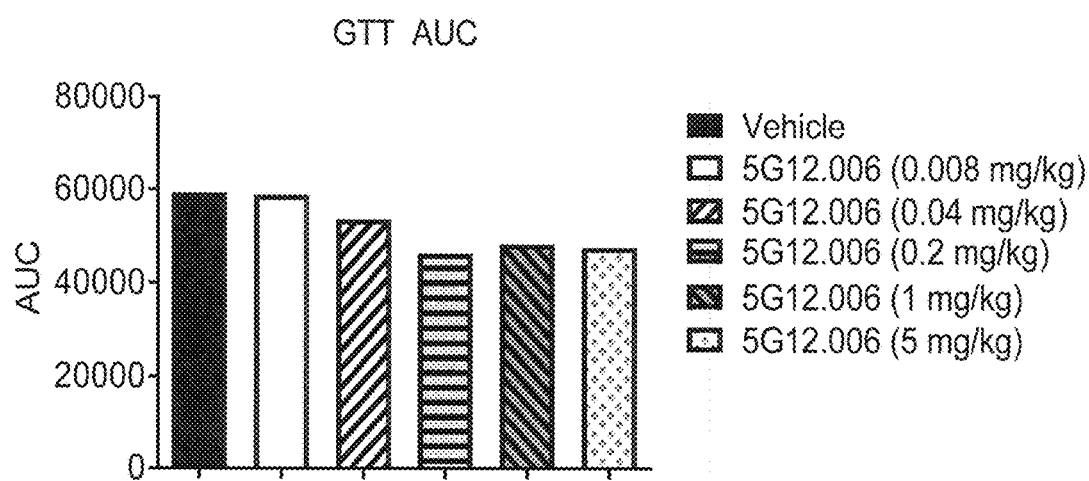
Figure 21A:
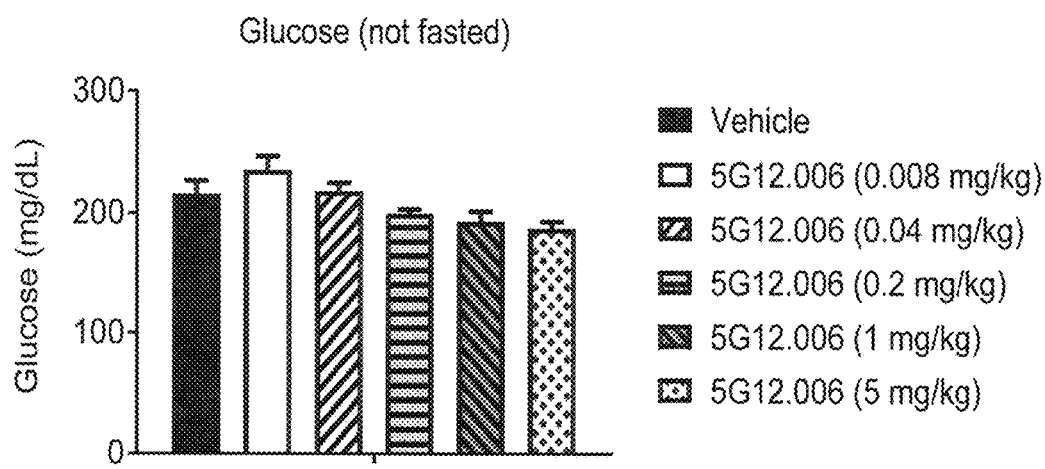
Figure 21B:
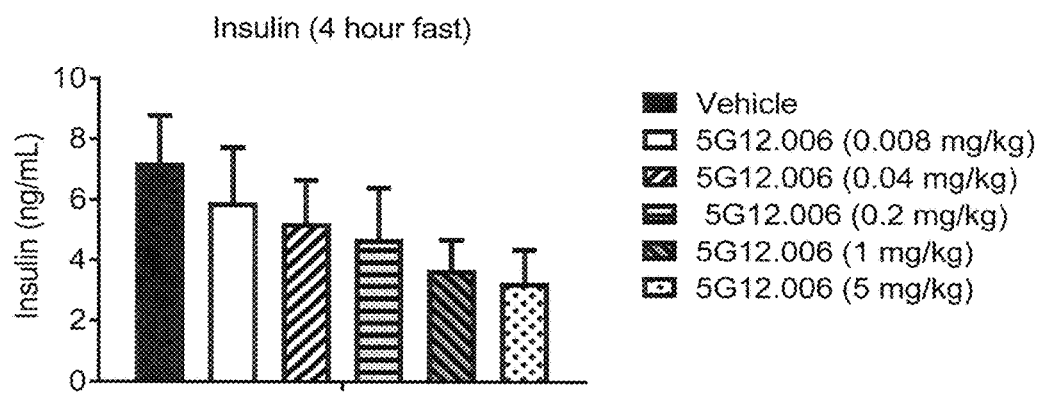
Figure 23A:
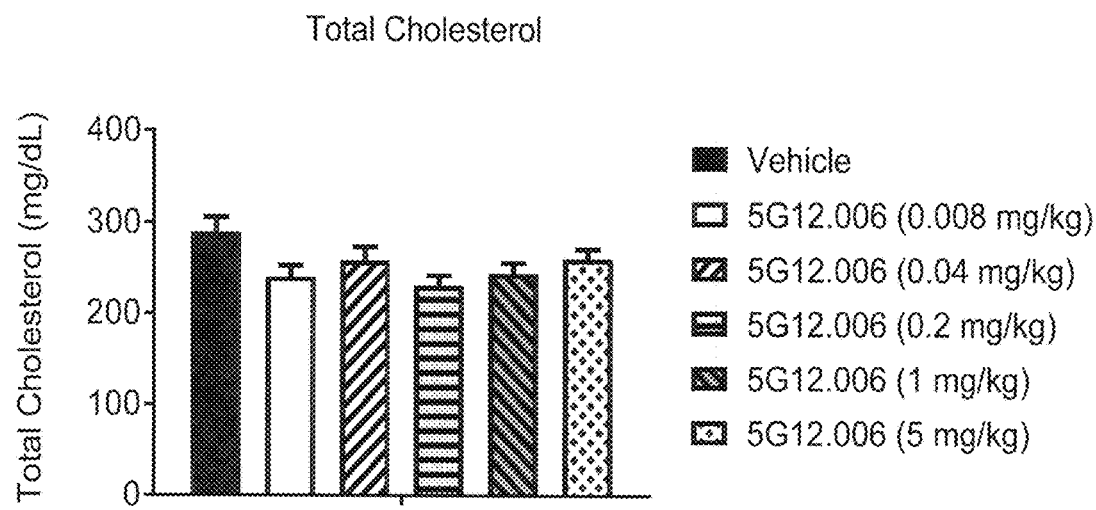
Figure 23B:
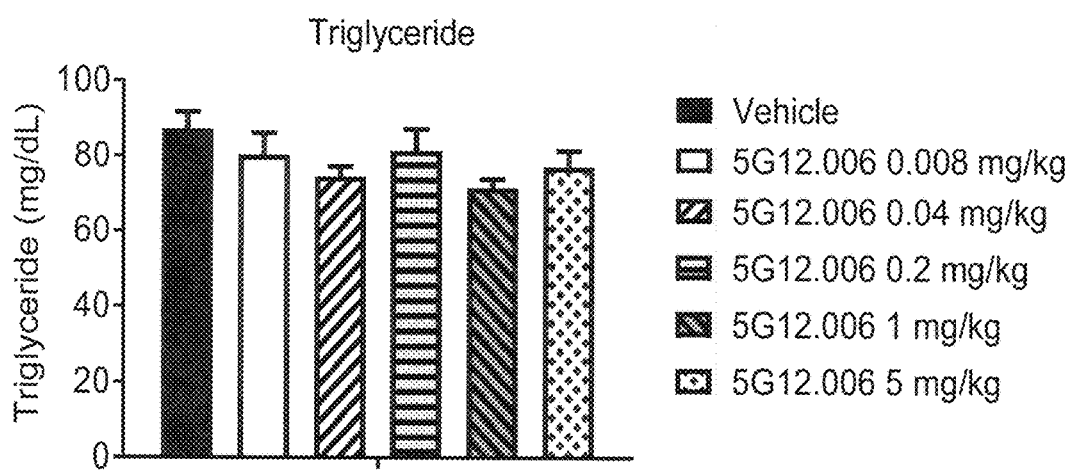

FIG. 19 shows that GIPR Antibody 5G12.006 treatment results in reduced body weight gain. FIG. 20 shows that GIPR Antibody 5G12.006 treatment results in improved glucose tolerance. FIG. 21 shows that GIPR Antibody 5G12.006 treatment results in lower glucose and insulin levels. FIG. 22 shows that GIPR Antibody 5G12.006 treatment results in lower liver weights. FIG. 23 shows that GIPR Antibody 5G12.006 total cholesterol levels.

EXAMPLE 9

Figure 24:
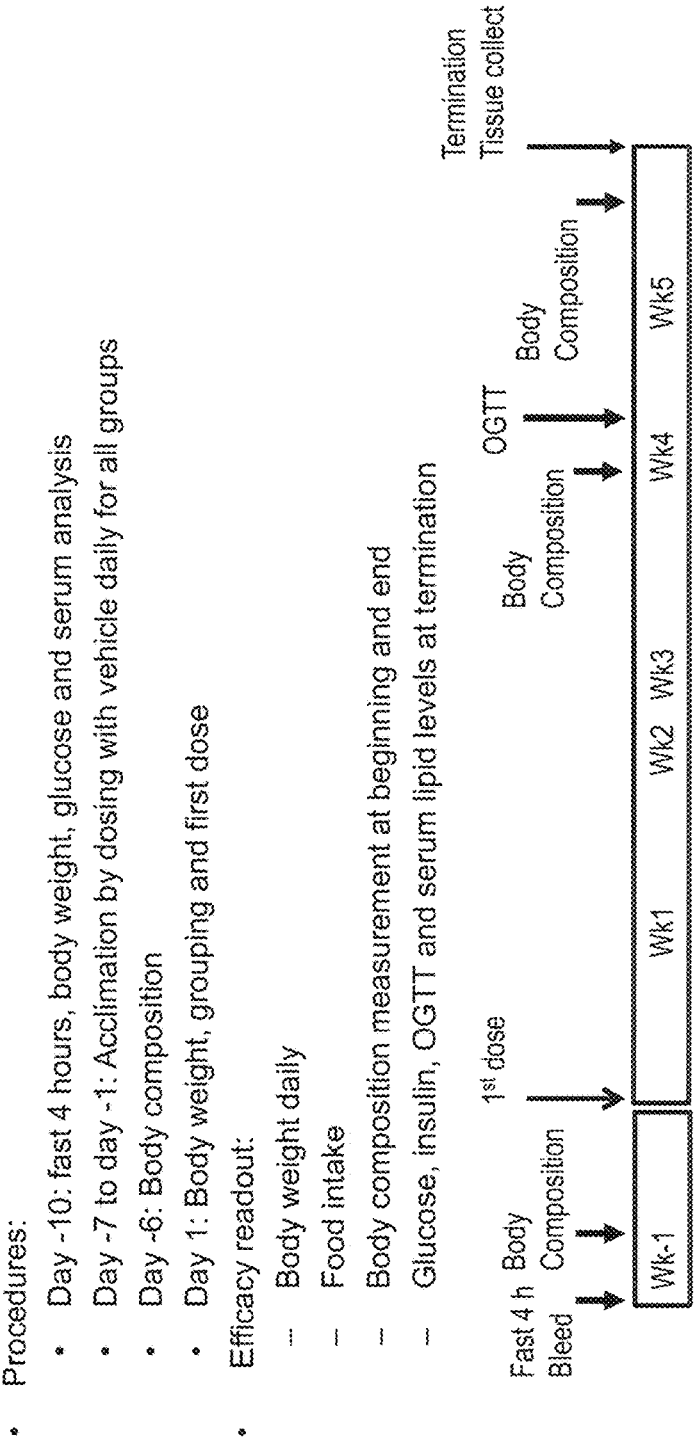
Figure 26A:
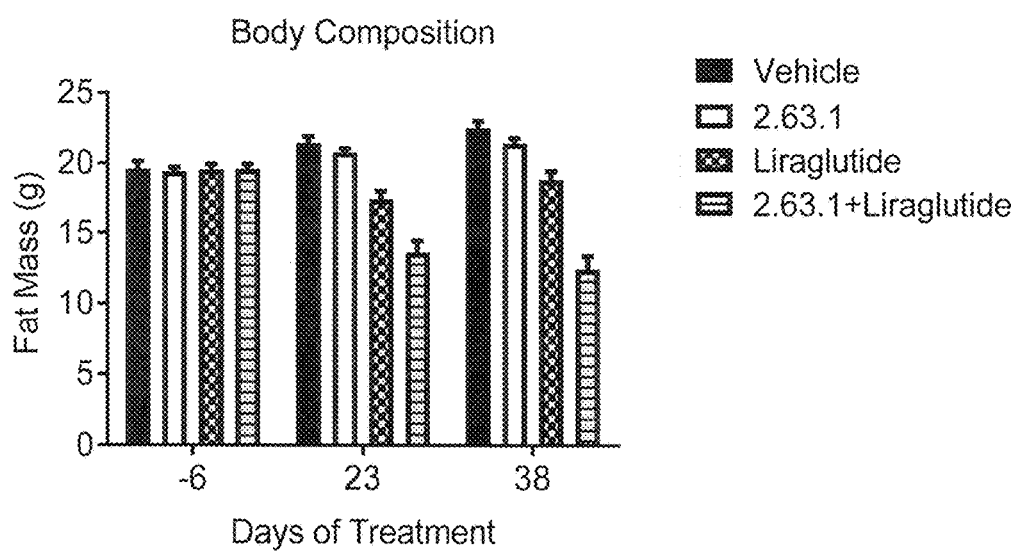
(FIG. 26A) Fat Mass, (FIG. 26B) Lean Mass, (FIG. 26C) Percent Fat Mass, and (FIG. 26D) Percent Lean Mass FIG. 27A-27B. Food Intake In Mice Treated With Anti-GIPR 2.63.1 In Combination With Liraglutide.
Figure 26B:
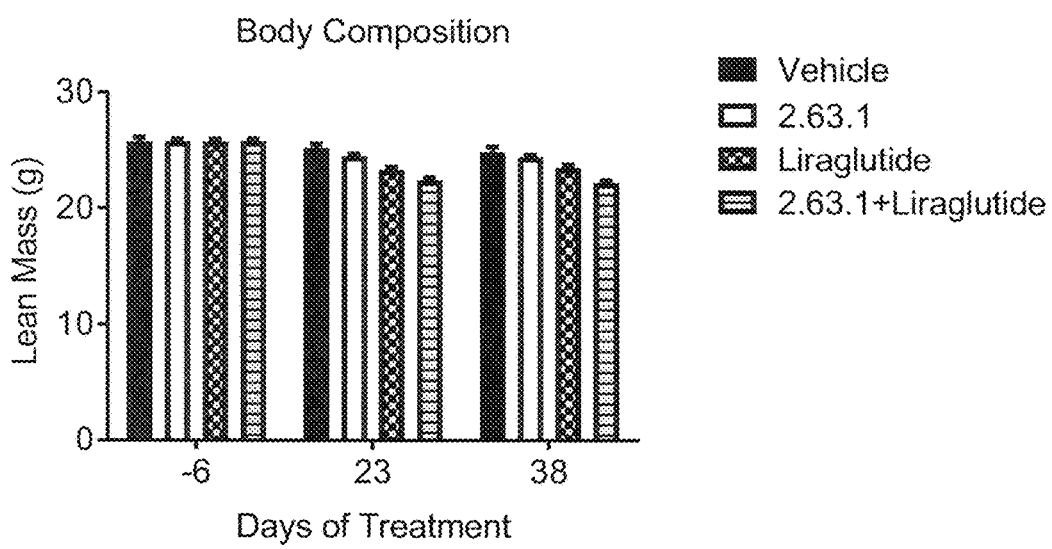
Figure 26C:
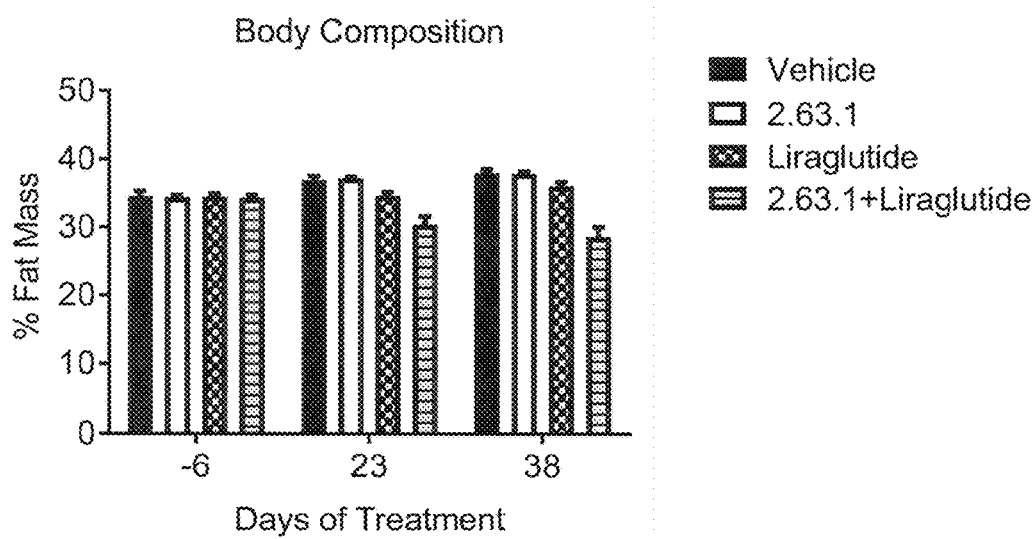
Figure 26D:
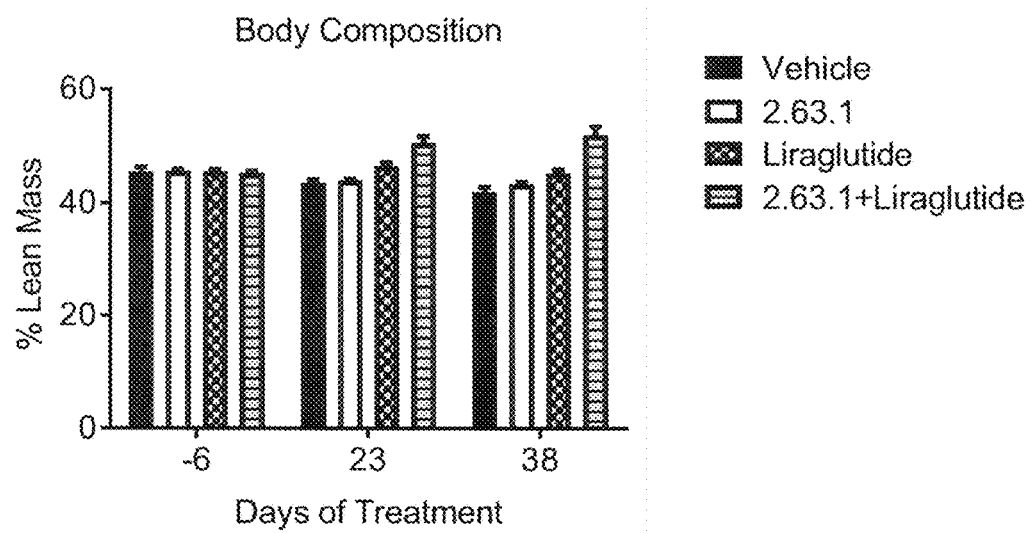
Figure 27A:
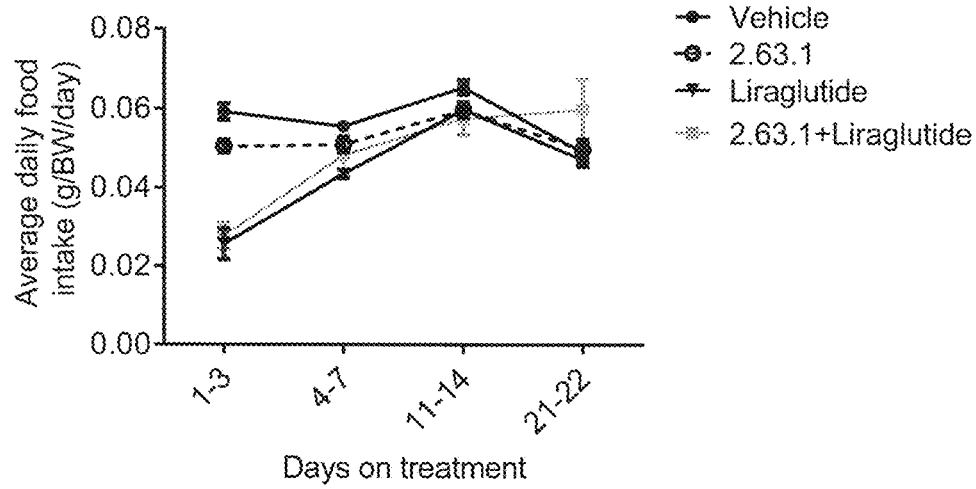
(FIG. 27A) g/BW/day and (FIG. 27B) g/day FIG. 28A-28C.
Figure 27B:
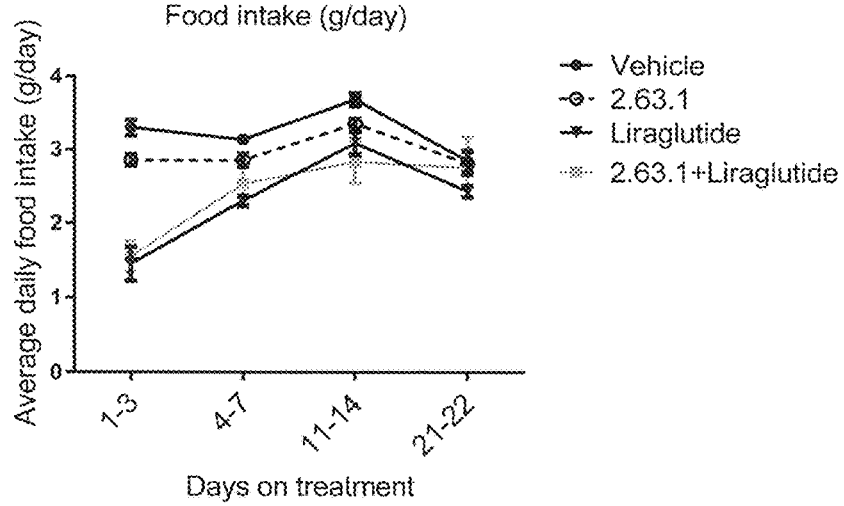
Figure 28A:
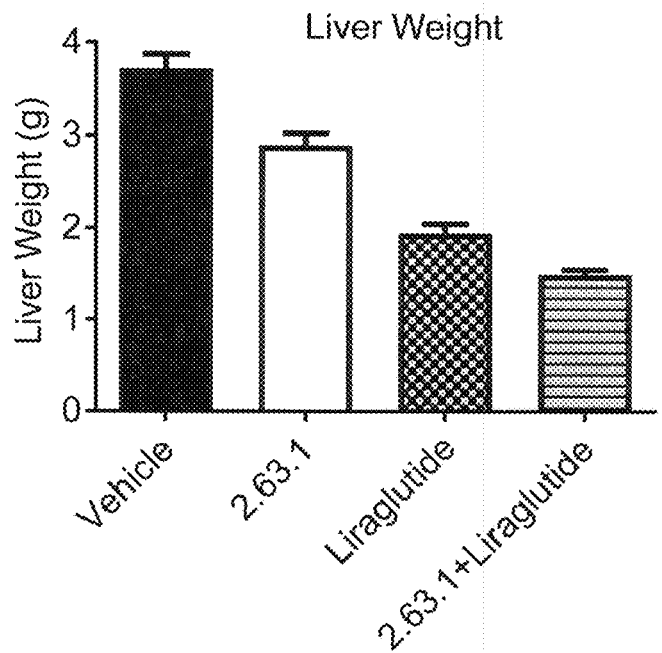
(FIG. 28A) Liver, (FIG. 28B) Epididymal Fat And (FIG. 28C) Inguinal Fat Weight In Mice Treated With Anti-GIPR 2.63.1 In Combination With Liraglutide FIG. 29A-29B. Glucose Tolerance In Mice Treated With Anti-GIPR 2.63.1 In Combination With Liraglutide as shown by (FIG. 29A) glucose levels and (FIG. 29B) AUC FIG. 30A-30B. Blood Glucose Levels In Mice Treated With Anti-GIPR 2.63.1 In Combination With Liraglutide.
Figure 28B:
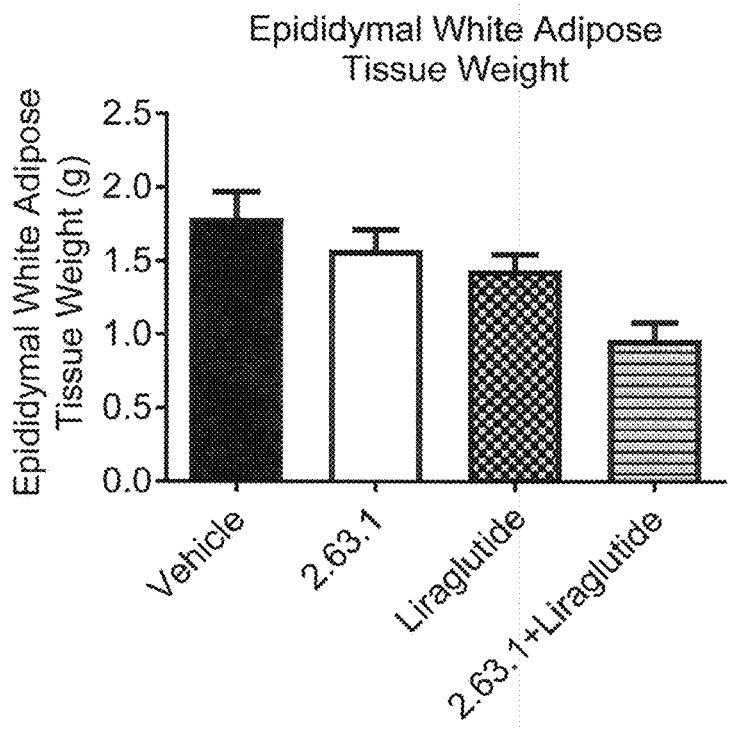
Figure 28C:
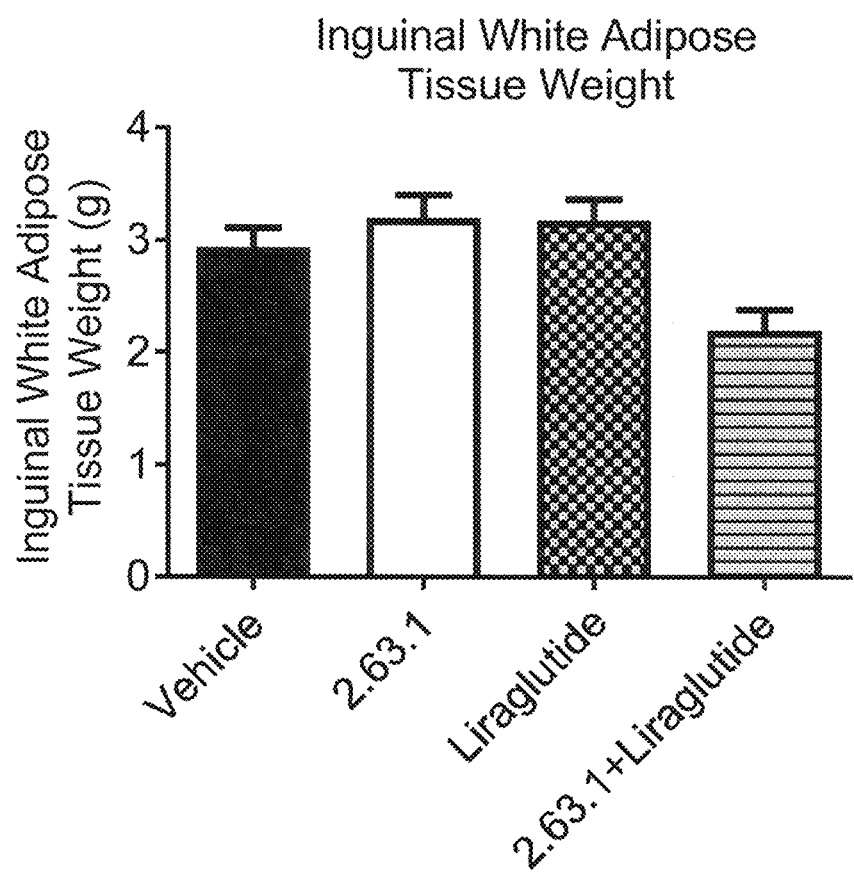
Figure 29A:
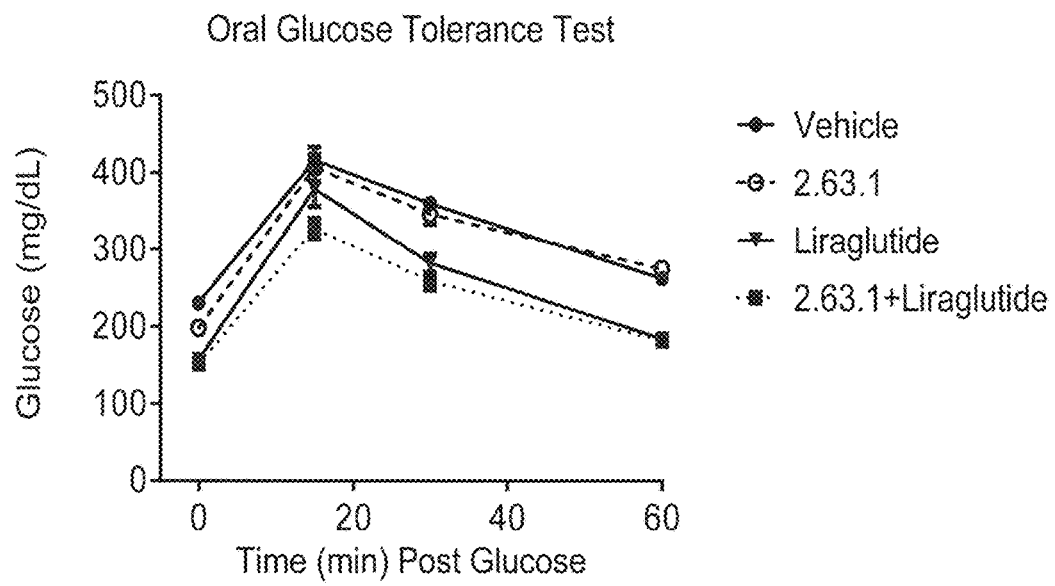
Figure 29B:
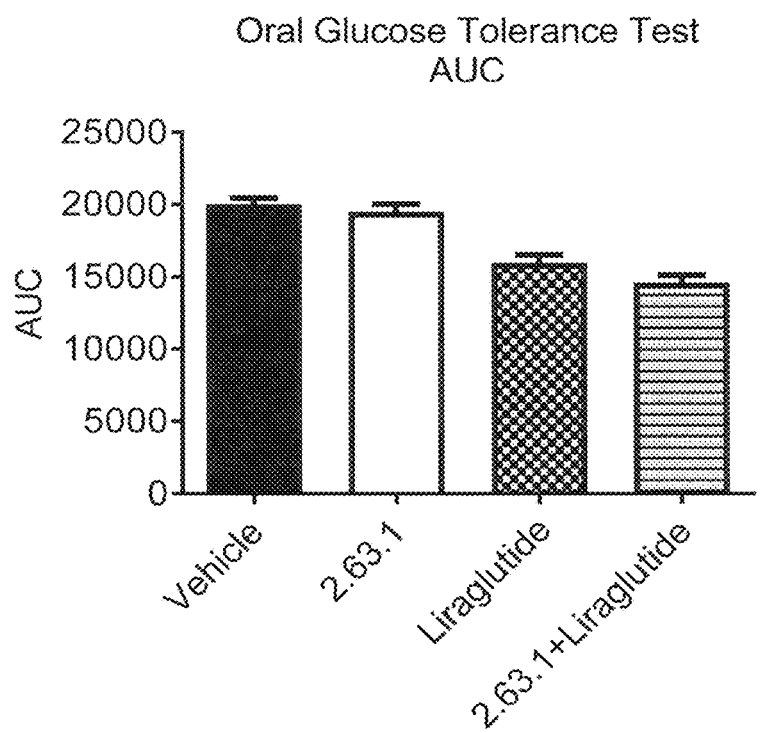
Figure 30A:
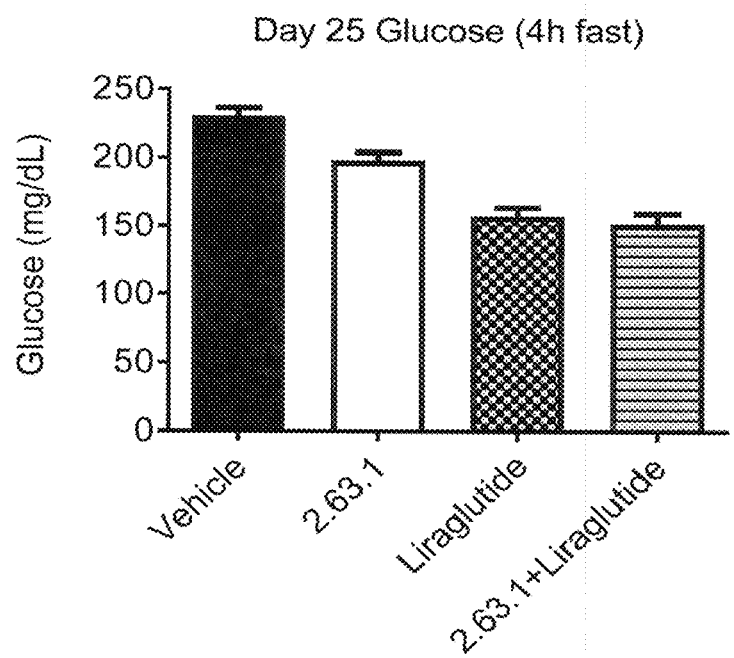
(FIG. 30A) day 25 and (FIG. 30B) day 39
Figure 30B:
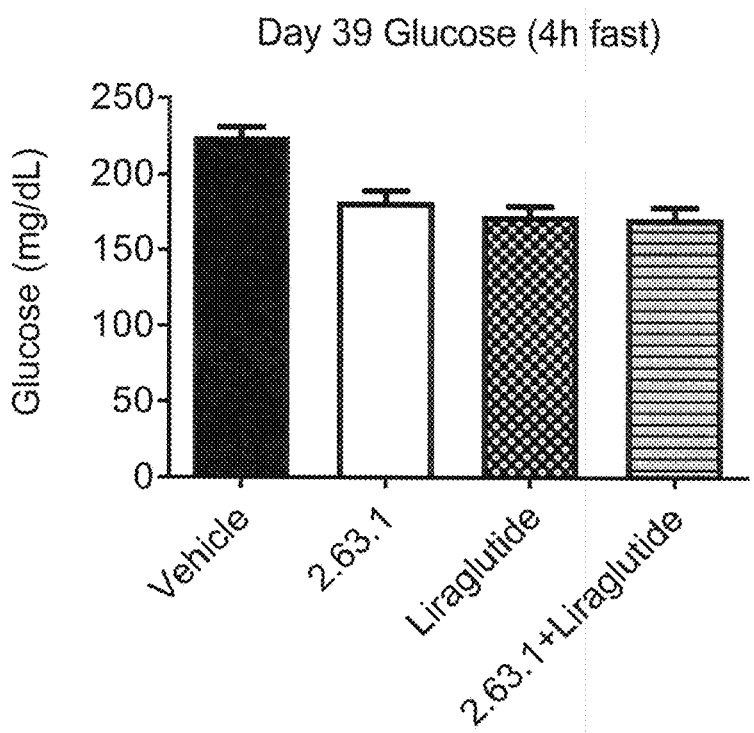
Figure 31A:
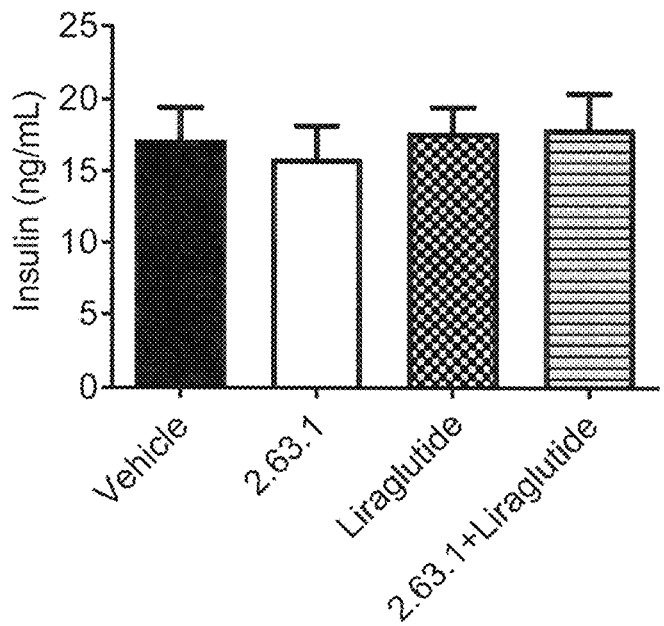
FIG. 31A-31D. Plasma Insulin Levels In Mice Treated With Anti-GIPR 2.63.1 In Combination With Liraglutide.
Figure 31B:
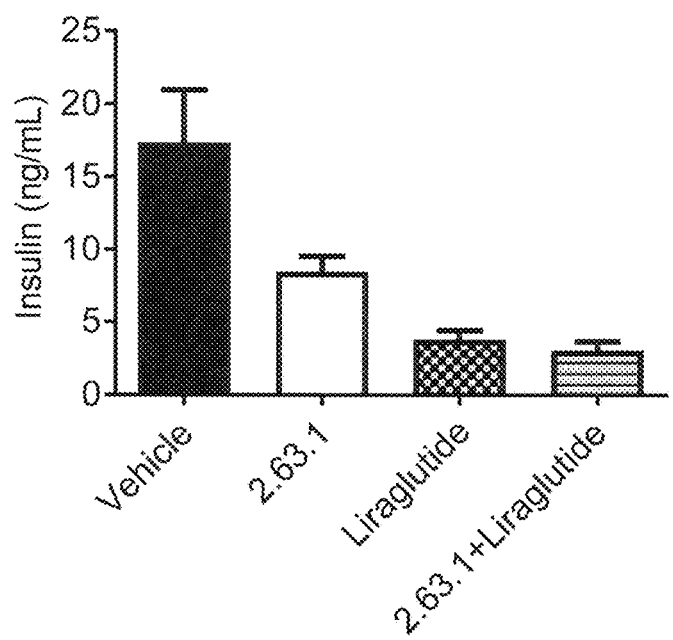
Figure 31C:
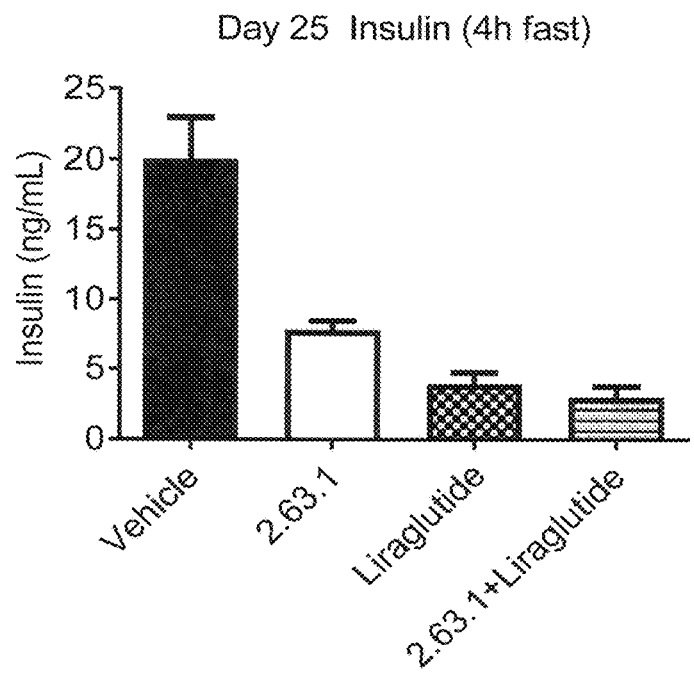
Figure 31D:
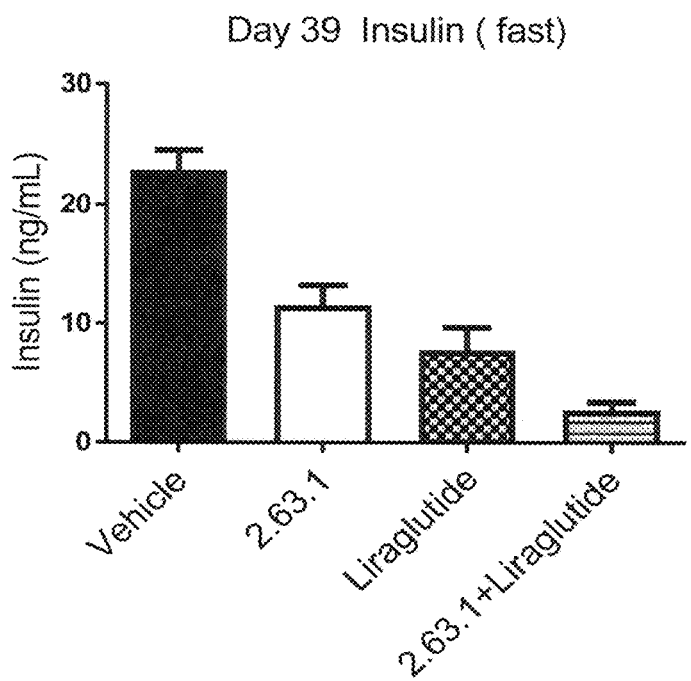
Figure 33:
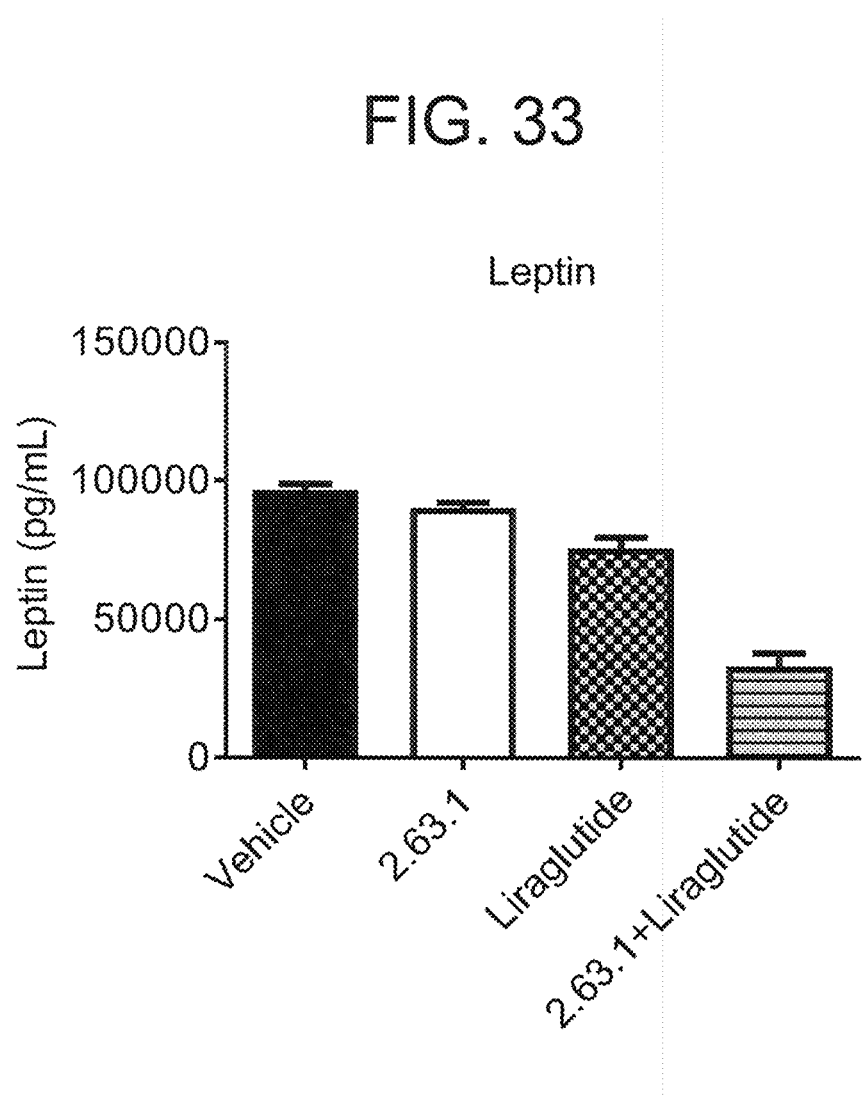
Figure 34A:
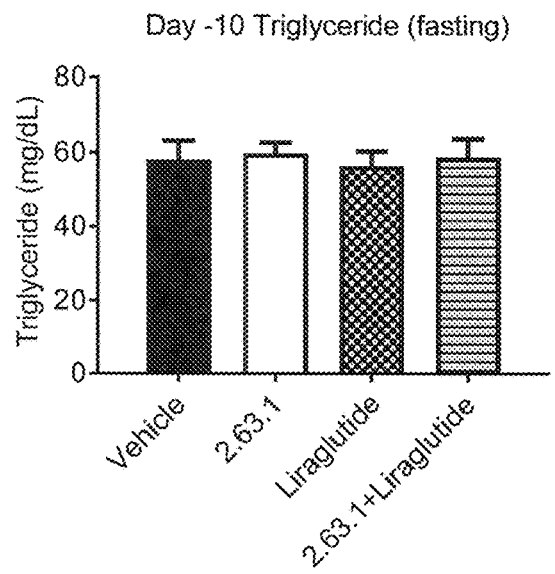
(FIG. 34A) day 10 (fasting), (FIG. 34B) day 22 (non-fasting), (FIG. 34C) day 25 (fasting), and (FIG. 34D) day 39 (non-fasting)
Figure 34B:
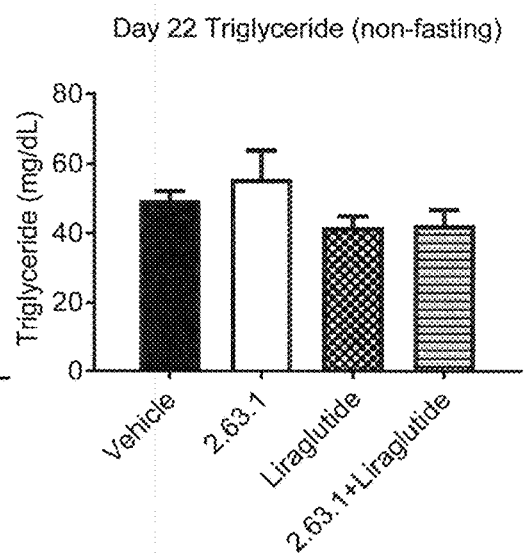
Figure 34C:
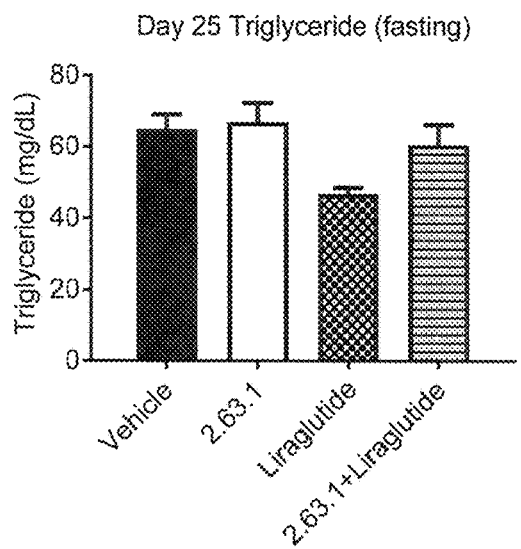
Figure 34D:
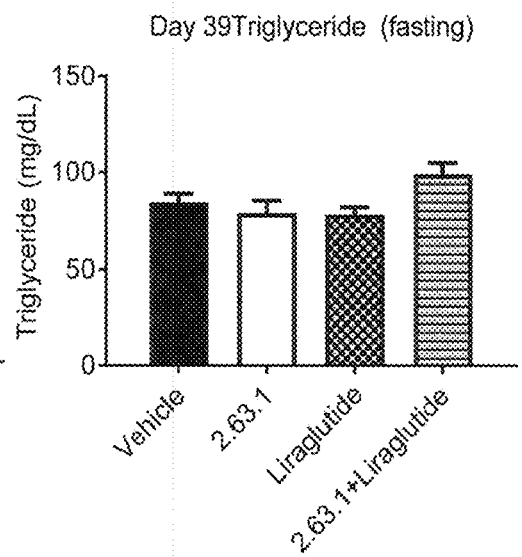
Figure 36A:
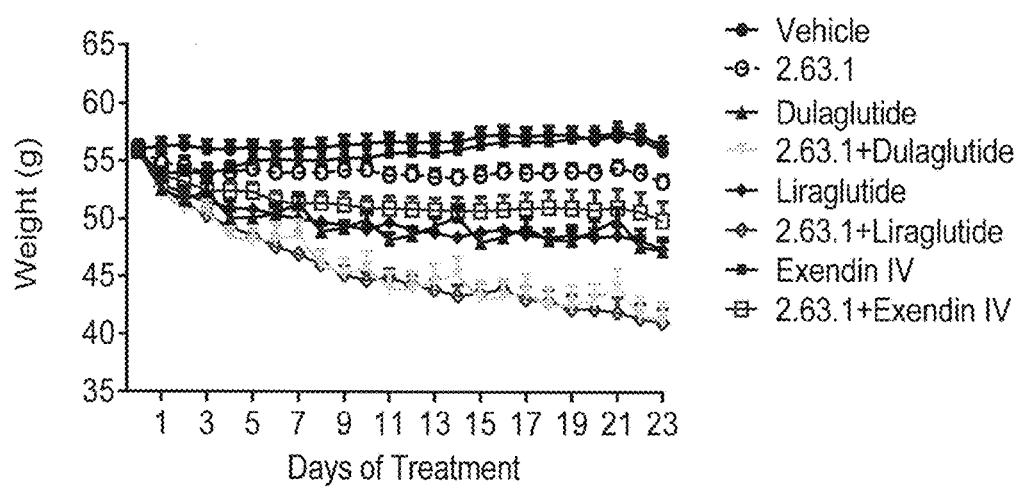
(FIG. 36A) weight (g) and (FIG. 36B) percent change body weight FIG. 37A-37D. Fat and Lean Mass In Mice Treated With Anti-GIPR 2.63.1 In Combination With Liraglutide, Dulaglutide Or Exendin IV.
Figure 36B:
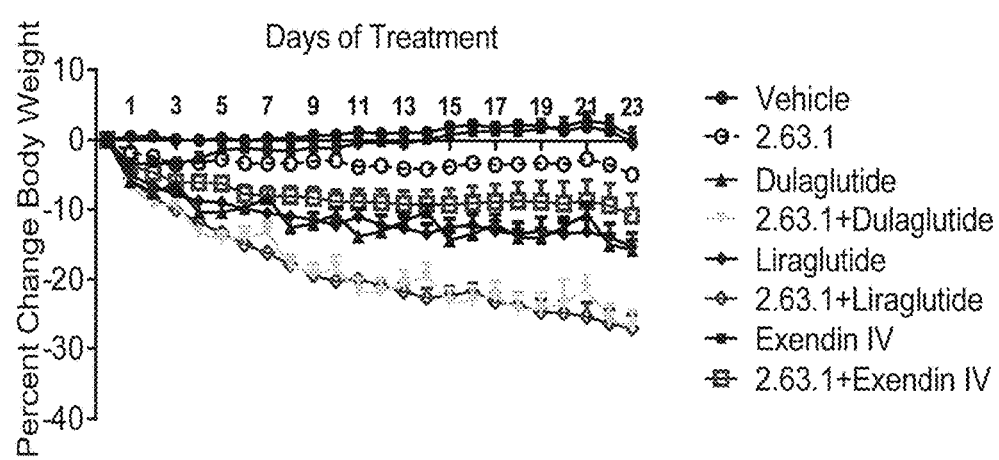
Figure 37A:
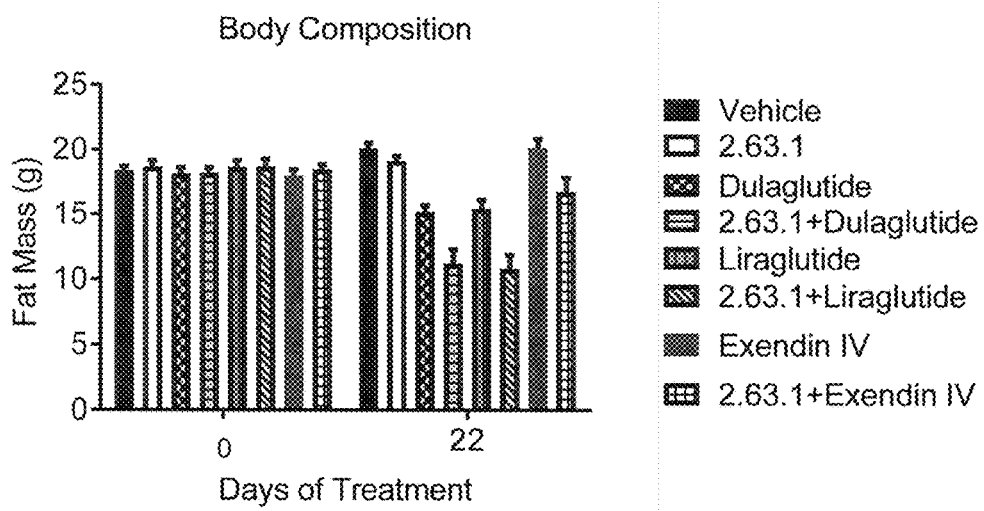
(FIG. 37A) Fat Mass, (FIG. 37B) Lean Mass, (FIG. 37C) Percent Fat Mass, and FIG. 37D) Percent Lean Mass FIG. 38A-38B. Food Intake In Mice Treated With Anti-GIPR 2.63.1 In Combination With Liraglutide, Dulaglutide Or Exendin IV.
Figure 37B:
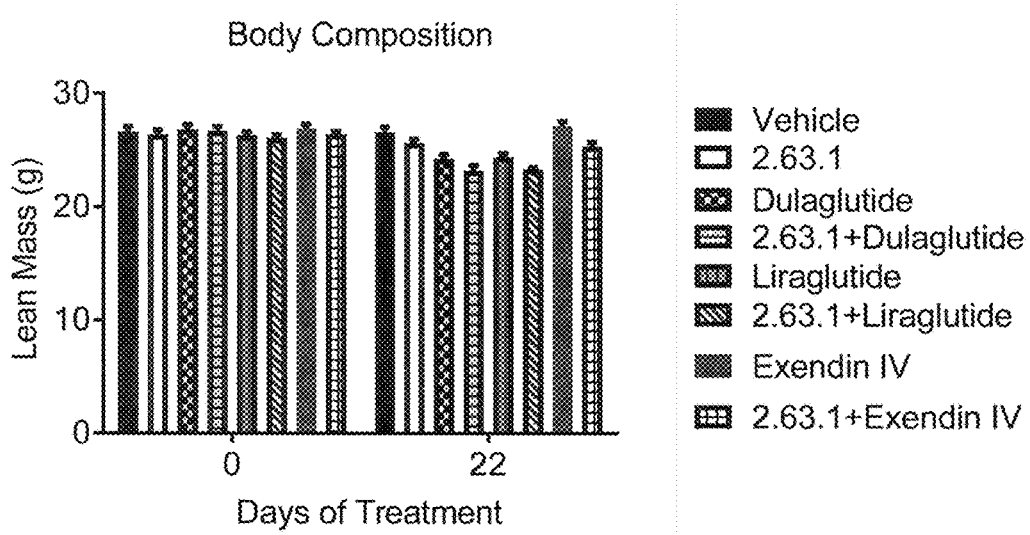
Figure 37C:
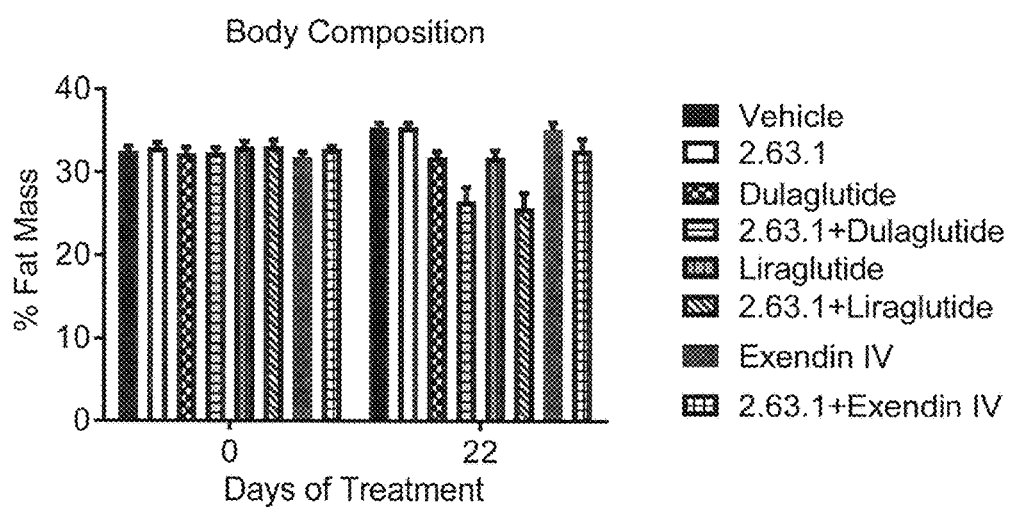
Figure 37D:
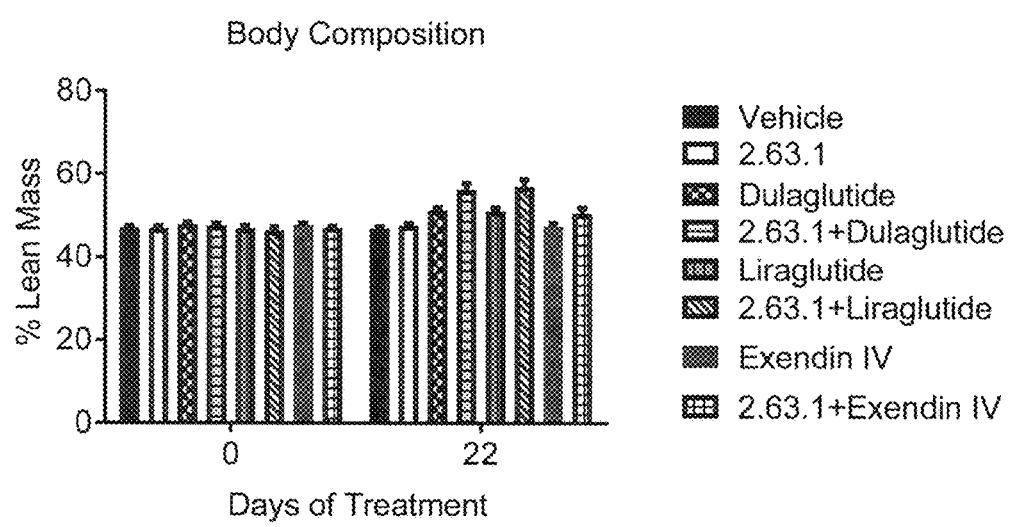
Figure 38A:
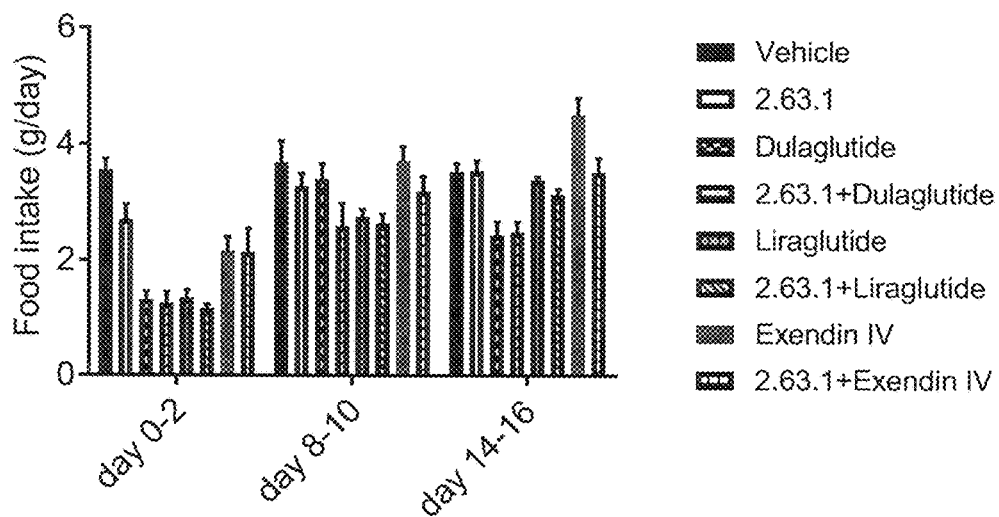
(FIG. 38A) g/day and (FIG. 38B) g/BW/day FIG. 39A-39D.
Figure 38B:
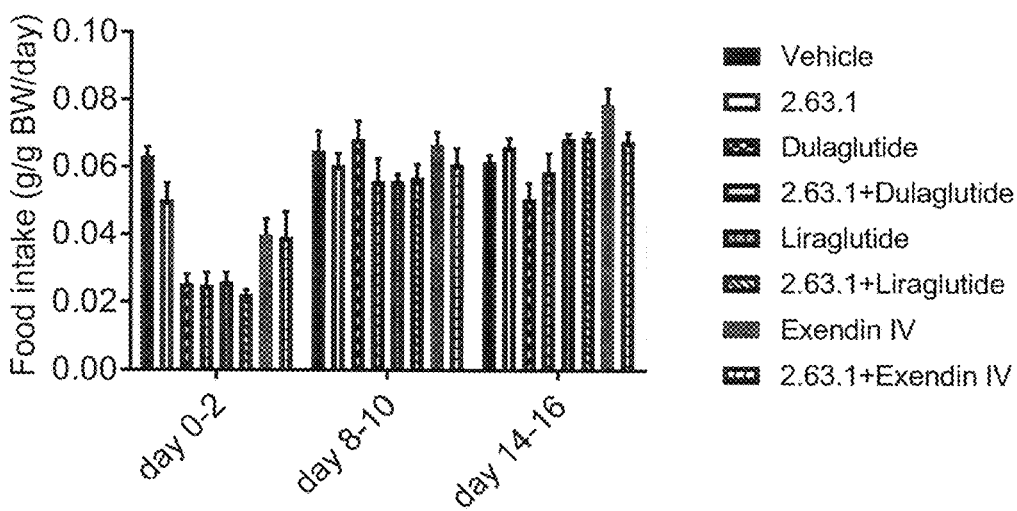
Figure 39A:
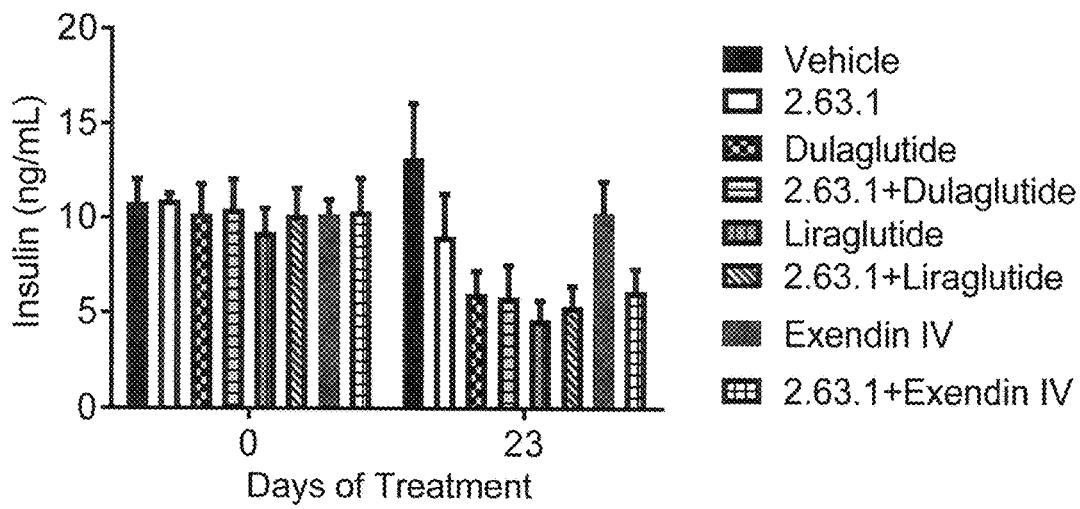
(FIG. 39A) Insulin, (FIG. 39B) Glucose And Glucose Tolerance ((FIG. 39C) Glucose and (FIG. 39D) AUC) In Mice Treated With Anti-GIPR 2.63.1 In Combination With Liraglutide, Dulaglutide Or Exendin IV FIG. 40A-40B.
Figure 39B:
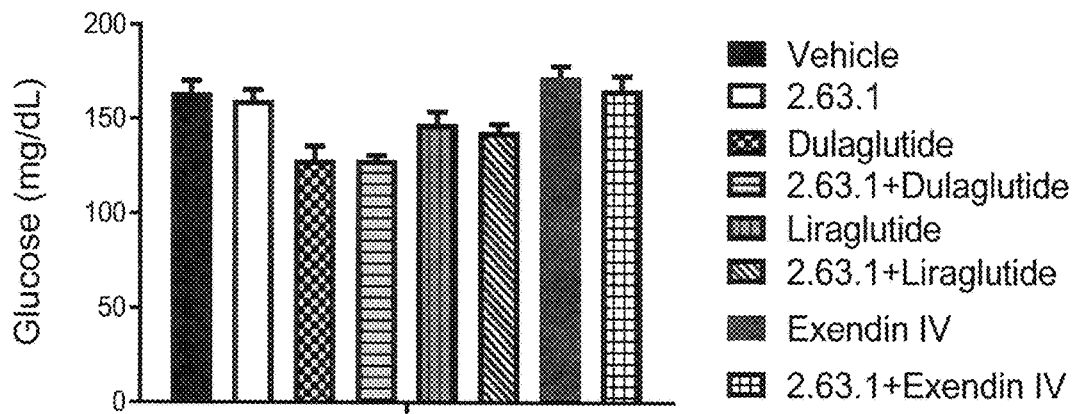
Figure 39C:
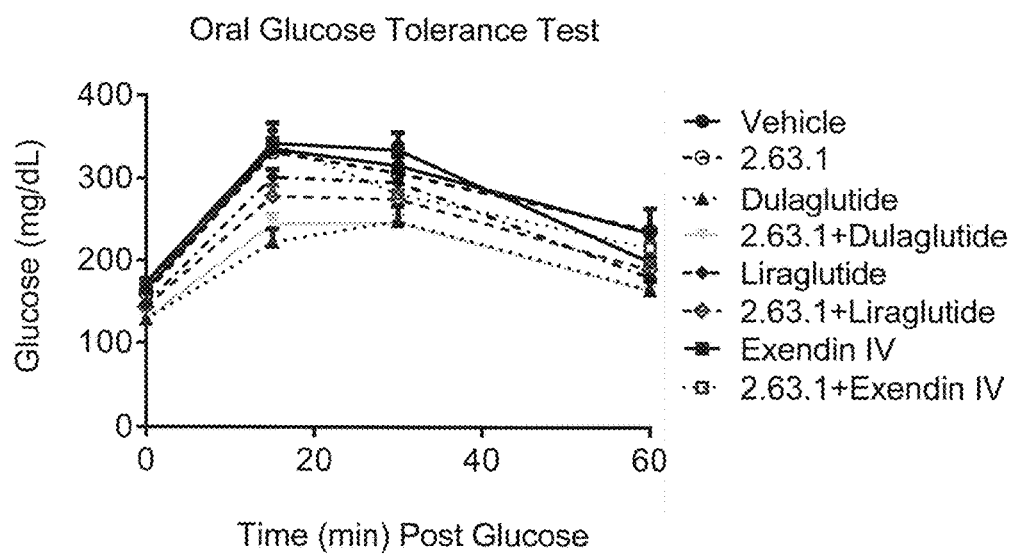
Figure 39D:
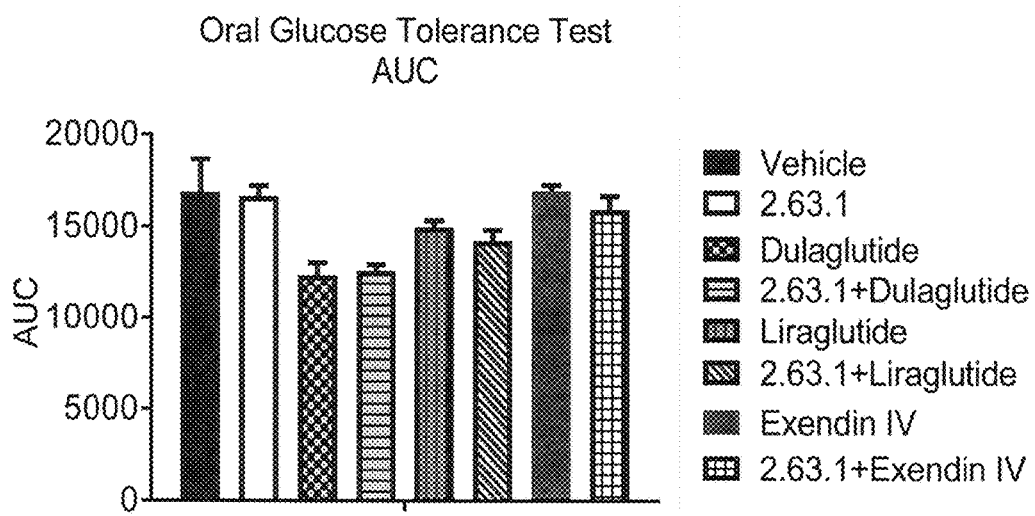
Figure 40A:
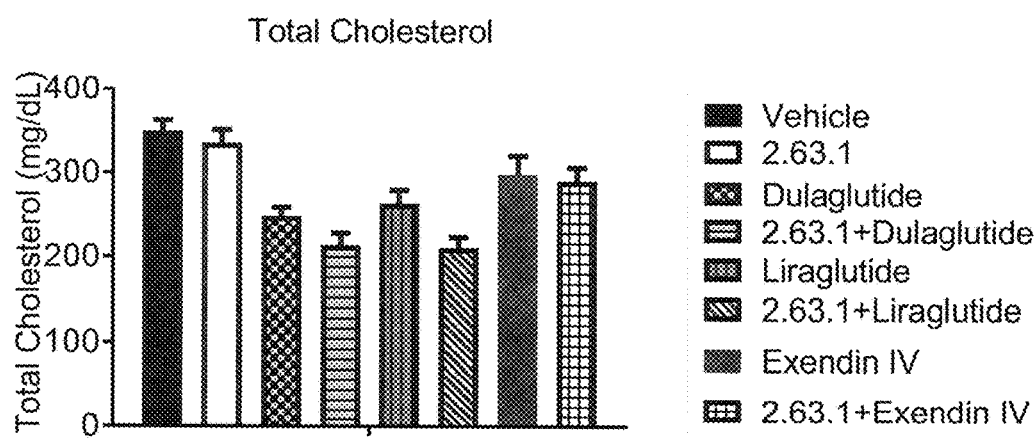
(FIG. 40A) Serum Total Cholesterol And (FIG. 40B) Triglyceride In Mice Treated With Anti-GIPR 2.63.1 In Combination With Liraglutide, Dulaglutide Or Exendin IV FIG. 41. Anti-GIPR Treatment In Mice Pre-treated with A GLP-1 Analog—Study Design. Diet-induced Obese (DIO) mice dosed with combination of 1) daily saline or Liraglutide (Lira), and 2) weekly vehicle or the GIPR Antibody (Ab). An overview of the study divided into 2 phases: Phase 1 consisted of two doses of Liraglutide. Phase 2 consisted of the GIPR Ab in addition to Liraglutide dosed mice from Phase 1. During Phase 1 and 2, a group of mice were simultaneously dosed with Liraglutide and GIPR Ab to establish the maximal percent weight loss.
Figure 40B:
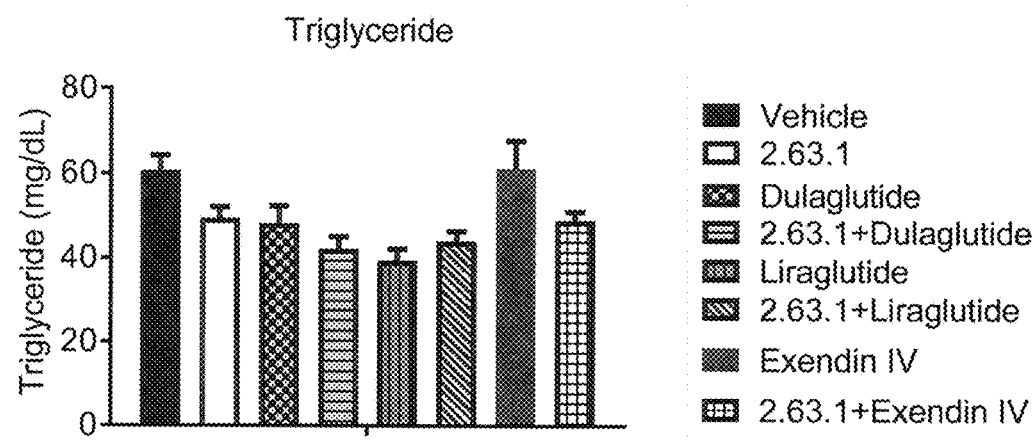

FIG. 24 provides an overview of the study used to determine the effects of chronic treatment of diet induced obese (DIO) mice with the mouse anti-mouse GIPR Ab (2.63.1) in combination with the GLP-1R agonist Liraglutide. Male C57BL/6 DIO mice were purchased from Jackson laboratory. Mice were single housed and continued on high fat diet (60 kcal % fat, Research Diets). Mice at 35 weeks old were randomized into groups and received one of the following treatments: A: vehicle (10 mM acetate, 9% sucrose, pH 5.2, and saline); B: 2.63.1 (30 mg/kg, twice a week); C: Liraglutide (0.3 mg/kg, once a day) and D: 2.63.1 (30 mg/kg, twice a week) and Liraglutide (0.3 mg/kg, once a day). All treatments were administrated intraperitoneally.

Blood samples were collected from tail vein or cardiac puncture at termination. Serum insulin levels were determined by using mouse high range insulin ELISA (ALPCO Diagnostics). Serum leptin levels were measured using mouse and rat leptin ELISA kit from BioVendor. The triglyceride levels were measured using an infinity triglyceride assay kit (Thermo Scientific). Total cholesterol was measured using an infinity total cholesterol kit (Thermo Scientific). At termination, liver, epididymal fat and inguinal fat were isolated and weighed using a balance.

Body composition was determined using the minispec whole body composition analyzer (Bruker).

For the oral glucose tolerance test (OGTT), mice were fasted for 4 hours. Glucose levels were measured and blood samples were taken from the tail vein before the OGTT was initiated. A bolus of glucose (2 g/kg) was given orally by a gavage needle. Glucose levels were measured at 15, 30 and 60 min after glucose administration using a glucose meter (Abbott).

FIGS. 25-34 show that treatment with anti-mouse GIPR (antibody 2.63.1) alone prevented weight gain, lowered glucose and insulin. In addition, there was dramatic weight loss from treatment of 2.63.1 in combination with Liraglutide. The effect is more than additive as the weight loss upon treatment with the combination was greater than the sum of the weight loss provided by each agent in isolation, indicating asynergistic effect. The reduced body weight was predominantly loss of fat mass. The mice had improved glucose and insulin levels and improved glucose tolerance from Liraglutide alone and combination. The mice also had significantly lowered serum total cholesterol levels.

EXAMPLE 10

FIG. 35 provides an overview of the study used to determine the effects of chronic treatment of diet induced obese (DIO) mice with the mouse anti-mouse GIPR Ab (2.63.1) in combination with GLP-1R agonists Liraglutide, Dulaglutide or Exendin IV. Male C57BL/6 DIO mice were purchased from Jackson laboratory. Mice were singly housed and continued on high fat diet (60 kcal % fat, Research diet) after arrival. Mice at 37 weeks old were randomized into groups and received one of the following treatments: A: vehicle (10 mM acetate, 9% sucrose, pH 5.2 once a week, and saline once a day); B: 2.63.1 (25 mg/kg, once a week); C: DDulaglutide (1 mg/kg, twice a week); D: 2.63.1 (25 mg/kg, once a week) and DDulaglutide (1 mg/kg, twice a week); E: Liraglutide (0.3 mg/kg, once a day); F: 2.63.1 (25 mg/kg, once a week) and Liraglutide (0.3 mg/kg, once a day); G: Exendin IV (0.01 mg/kg, once a day); H: 2.63.1 (25 mg/kg, once a week) and Exendin IV (0.01 mg/kg, once a day). All treatments were administrated intraperitoneally.

Blood samples were collected from tail vein or cardiac puncture at termination. Serum insulin levels were determined by using mouse high range insulin ELISA (ALPCO Diagnostics). The triglyceride levels were measured using an infinity triglyceride assay kit (Thermo Scientific). Total cholesterol was measured using an infinity total cholesterol kit (Thermo Scientific).

Body composition was determined using the minispec whole body composition analyzer (Bruker).

For oral glucose tolerance test, mice were fasted for 4 h. Glucose levels were measured and blood samples were taken from the tail vein before the OGTT was initiated. A bolus of glucose (2 g/kg) was given orally by a gavage needle. Glucose levels were measured at 15, 30 and 60 min after glucose administration using a glucose meter (Abbott).

This study demonstrates that GIPR Ab 2.63.1 has synergistic effect on weight loss and fat mass loss with the GLP-1R agonists tested: Liraglutide, Dulaglutide, and Exendin IV (FIGS. 35-40).

EXAMPLE 11

Figure 41:
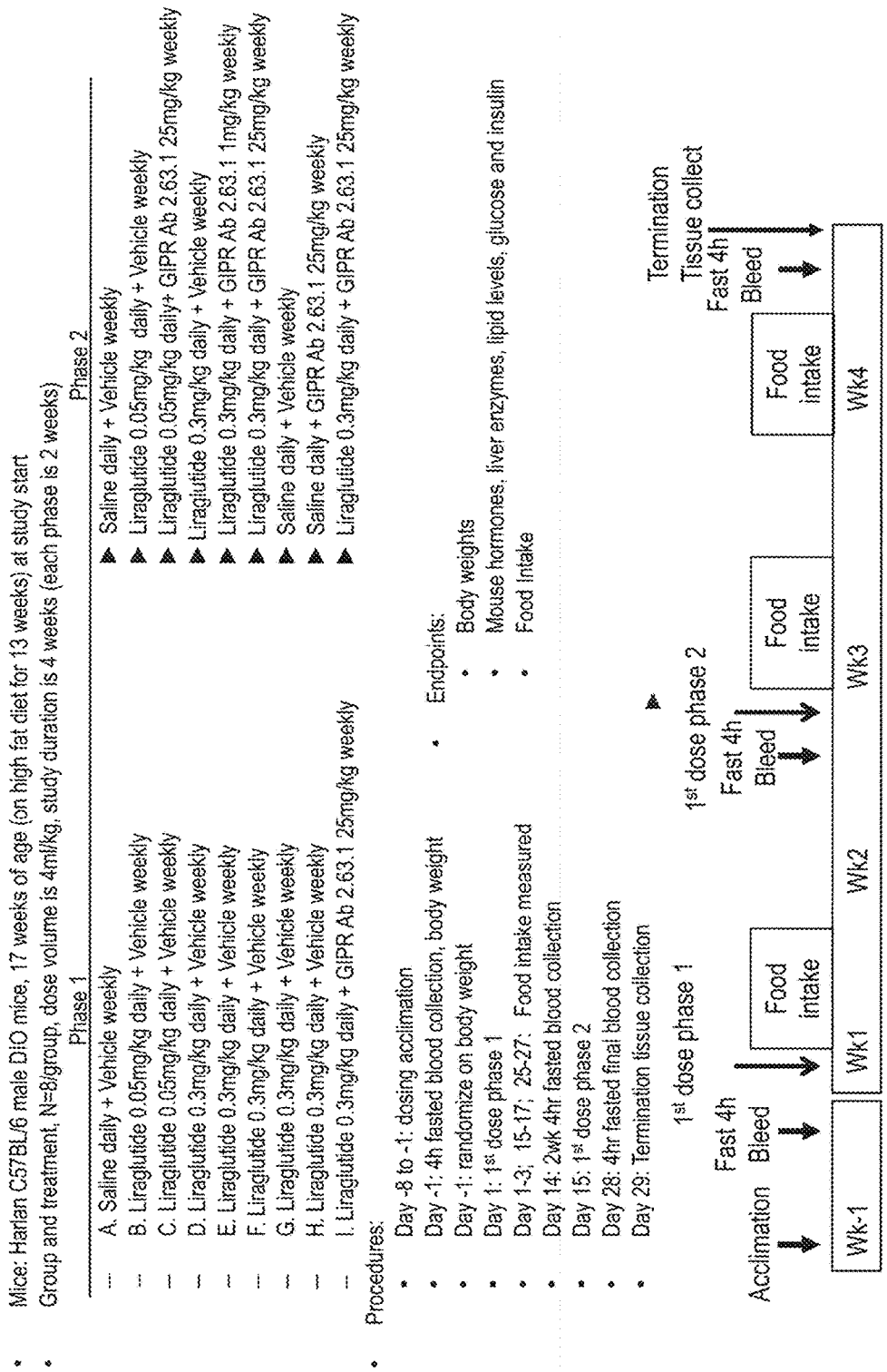
Figure 42B:
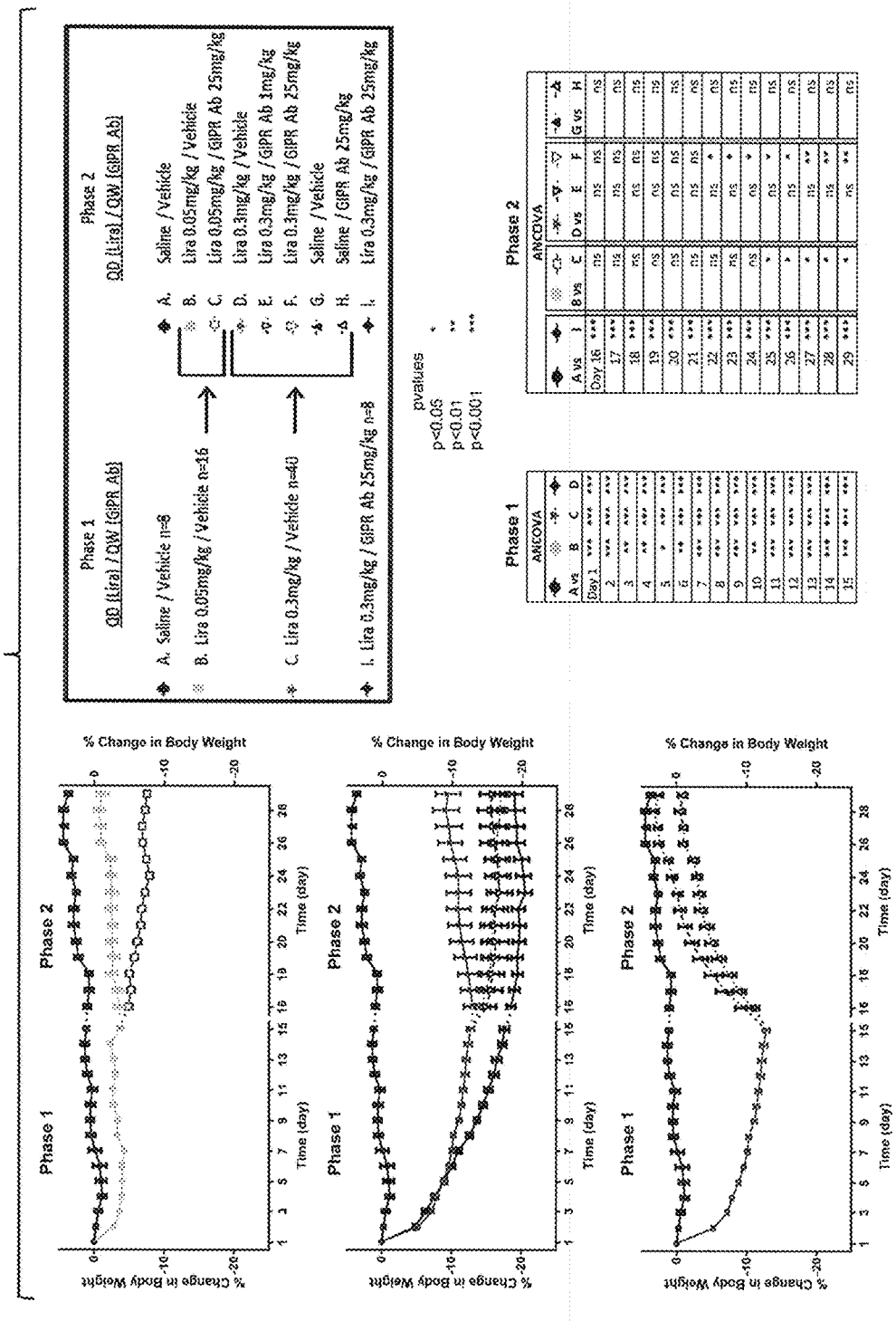
Figure 43:
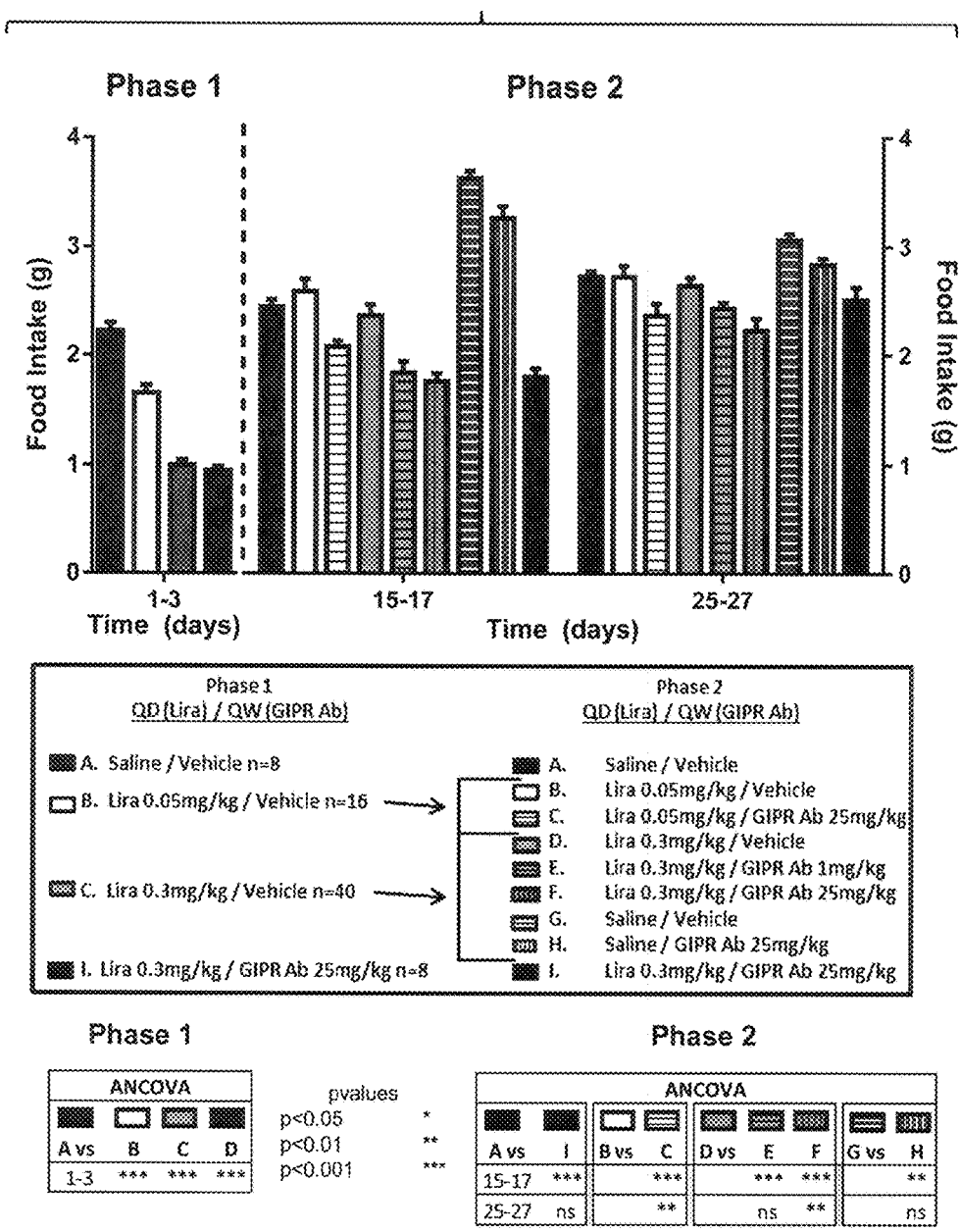
FIG. 43. Food Intake. Diet-induced Obese (DIO) mice dosed with combination of 1) daily saline or Liraglutide (Lira), and 2) weekly vehicle or the GIPR Antibody (Ab) and food intake was measured for 3 separate periods. The study was divided into 2 phases: Phase 1 established food intake changes at initiation of two doses of Liraglutide. Phase 2 established food intake changes at initiation and conclusion of the GIPR Ab in addition to Liraglutide dosed mice from Phase 1. During Phase 1 and 2, a group of mice were simultaneously dosed with Liraglutide and GIPR Ab to establish the maximal percent weight loss.
Figure 44:
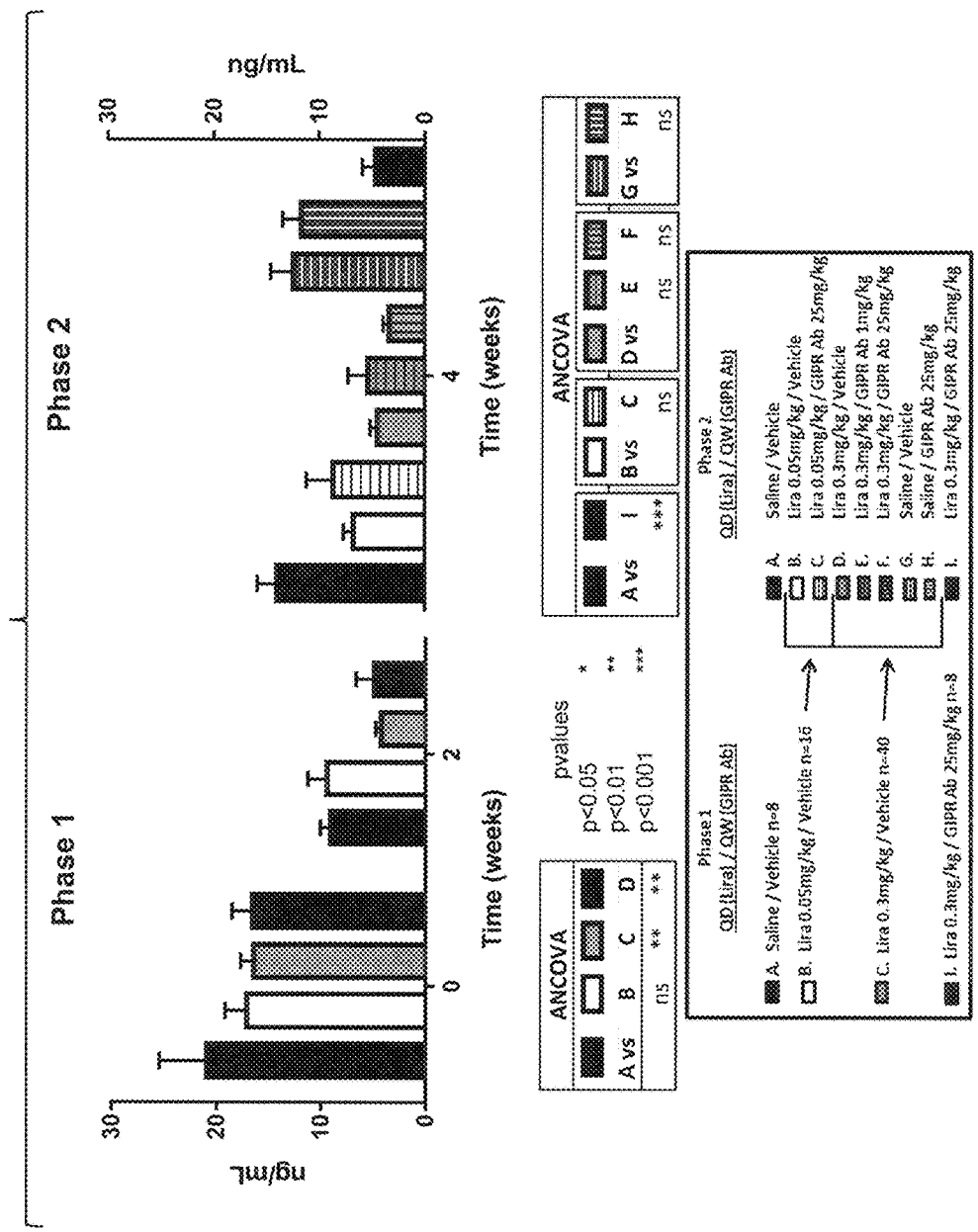
FIG. 44. Insulin. Diet-induced Obese (DIO) mice dosed with combination of 1) daily saline or Liraglutide (Lira), and 2) weekly vehicle or the GIPR Antibody (Ab) and insulin was measured for 3 separate periods. The study was divided into 2 phases: Phase 1 established insulin levels prior to two doses of Liraglutide. Phase 2 established insulin levels prior to the GIPR Ab in addition to Liraglutide dosed mice from Phase 1 and at the conclusion of Phase 2. During Phase 1 and 2, a group of mice were simultaneously dosed with Liraglutide and GIPR Ab to establish the maximal percent weight loss.
Figure 45A:
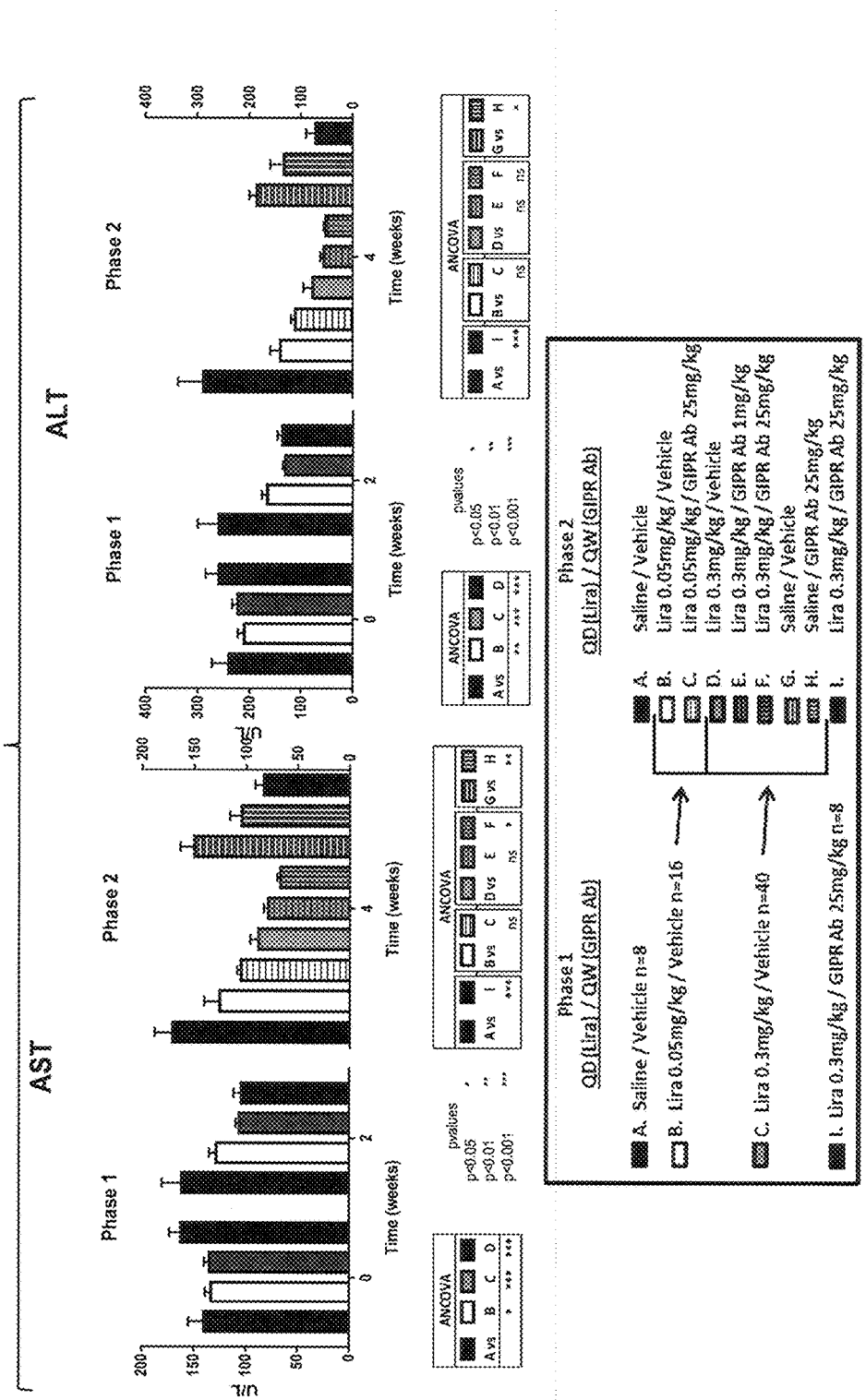
Figure 46:
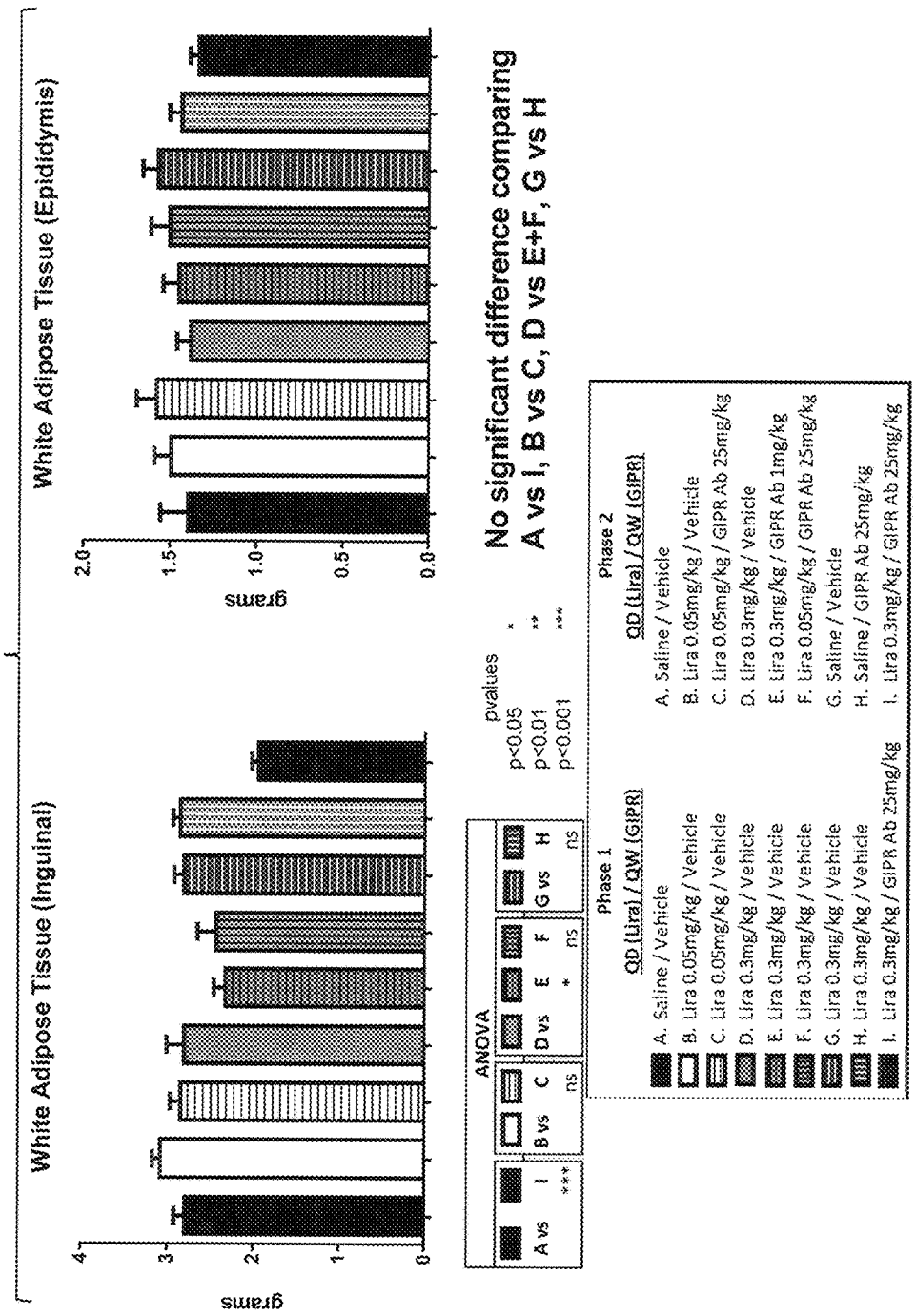
FIG. 46. Tissue Weights. Diet-induced Obese (DIO) mice dosed with combination of 1) daily saline or Liraglutide (Lira), and 2) weekly vehicle or the GIPR Antibody (Ab) and tissues were weighted at terminal tissue collection. The study was divided into 2 phases: Phase 1 consisted of two doses of Liraglutide. Phase 2 consisted of GIPR Ab in addition to Liraglutide dosed mice from Phase 1 and at the conclusion of Phase 2. During Phase 1 and 2, a group of mice were simultaneously dosed with Liraglutide and GIPR Ab to establish the maximal percent weight loss.

FIG. 41 provides an overview of the study used to determine the effects of chronic treatment of diet induced obese (DIO) mice pre-treated with Liragutide with the mouse anti-mouse GIPR Ab (2.63.1). C57BL/6 DIO male mice (17 week old) fed Research Diets D12492 (60% kcal fat) for 13 weeks were randomized into groups. During phase 1 (pre-treatment phase), animals were intraperitoneally dosed daily for 2 weeks with either 1) saline (0.9% sodium chloride), 2) Liraglutide (BAChem #H-6724-0005) at 0.05 mg/kg, 3) Liraglutide at 0.3 mg/kg, or 4) Liraglutide 0.3 mg/kg in combination with a weekly dose of mouse anti-mouse GIPR Ab (2.63.1) in vehicle (10 mM acetate, 9% sucrose, pH 5.2) at 25 mg/kg;ll other groups (1-3) received a weekly dose of vehicle. During phase 2 (experimental stage) mouse anti-mouse GIPR Ab (2.63.1) treatment was initiated in the animals pre-treated with Liraglutide. Blood glucose levels were measured from retro orbital sinus using a glucose meter (Abbott) after mice were fasted for 4 hours before phase 1, end of phase 1, and at the end of the experiment. Insulin levels were determined using mouse high range insulin ELISA (ALPCO Diagnostics). Food intake was averaged over 3 days at the beginning of phase 1, beginning of the phase 2, and end of the phase 2. At necropsy white adipose tissue (epididymis and inguinal) were collected along with terminal blood. Plasma was analyzed on the Olympus chemistry analyzer for liver enzymes, cholesterol, triglycerides, and NEFA. Plasma was analyzed in mouse metabolism multiplex assay (MM- HMAG-44K—EMD Millipore) for mouse hormones. These data demonstrate that the weight loss effect of anti-GIPR can be observed in animals already receiving GLP-1R agonist therapy (FIGS. 42-47).

EXAMPLE 12

In order to validate the effects of a GIPR antagonistic Ab alone or in combination with GLP1R agonist, a non-human primate (NHP) model was utilized.

Figure 48:
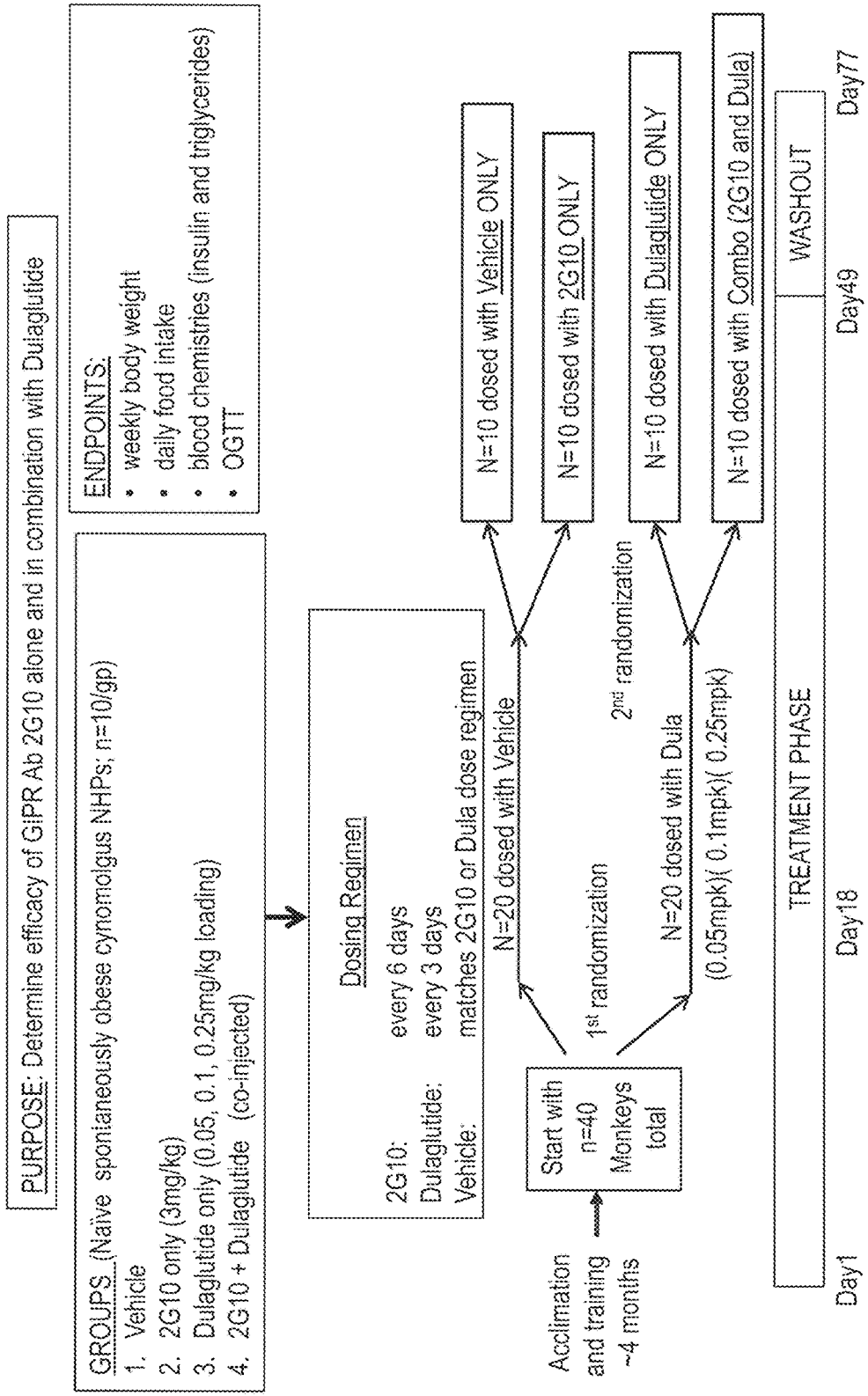
FIG. 48. GIPR Ab chronic study design in spontaneously obese cynomolgus monkeys.
Figure 49A:
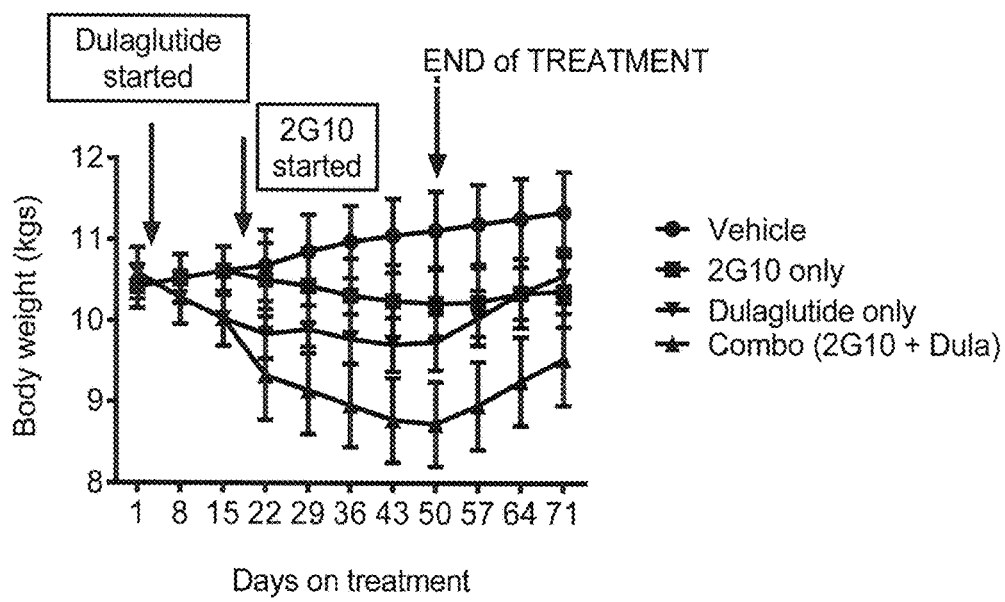
FIG. 49A-49B. 2G10 causes body weight reduction in spontaneous obese cynomolgus monkeys with or without dulaglutide.
Figure 49B:
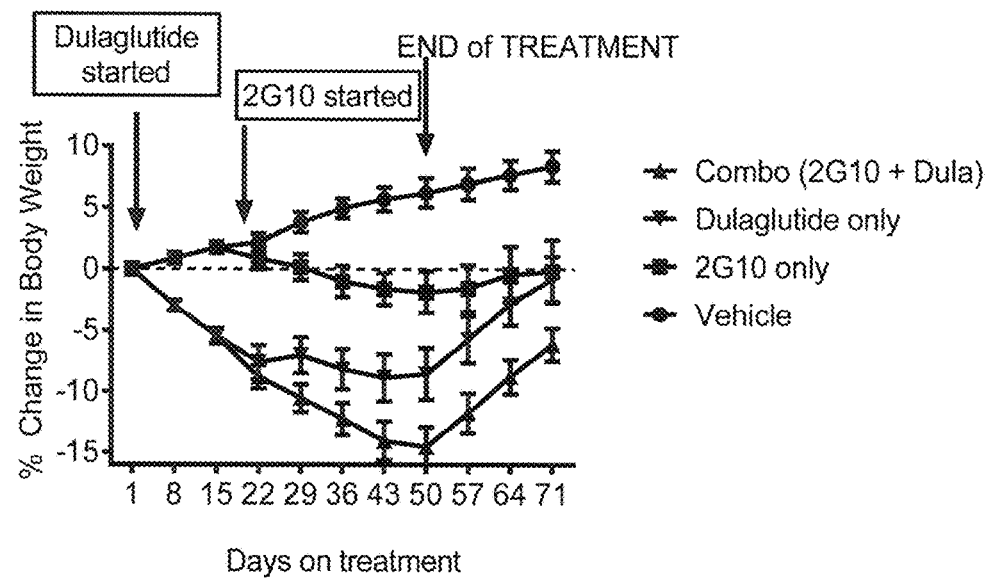
Figure 50A:
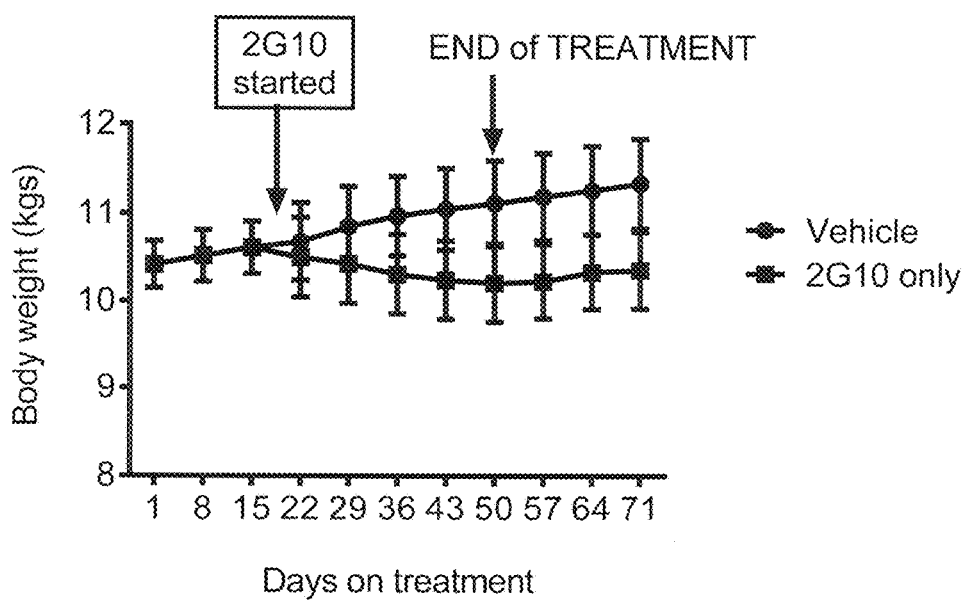
FIG. 50A-50B. 2G10 alone causes body weight reduction in spontaneously obese cynomolgus monkeys (baseline reinitiated at day 15 prior starting 2G10 treatment)
Figure 50B:
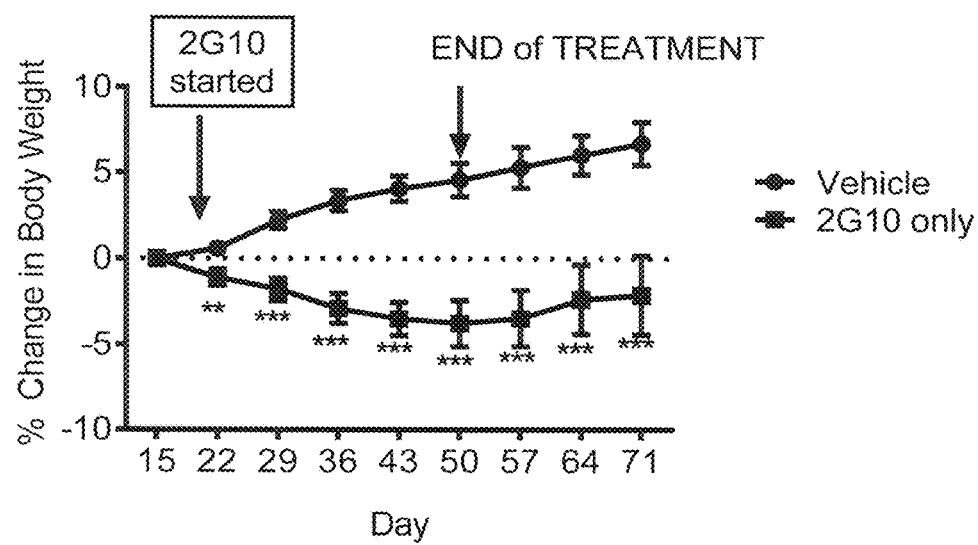
Figure 51A:
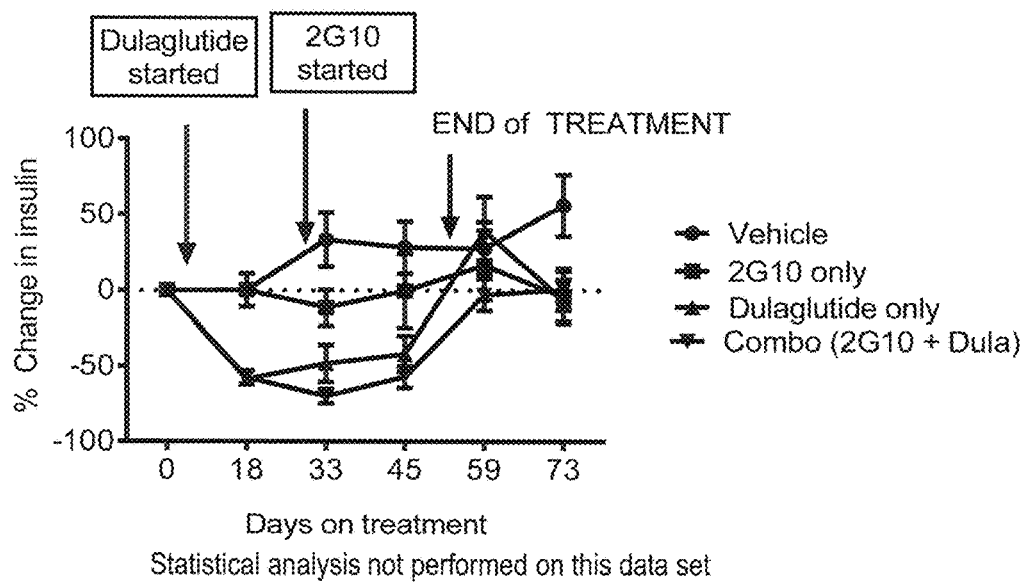
FIG. 51A-51B. 2G10 (FIG. 51A) prevents increase in insulin and (FIG. 51B) reduces triglycerides levels with or without Dulaglutide in overnight fasted spontaneously obese cynomolgus monkeys (% change from baseline).
Figure 51B:
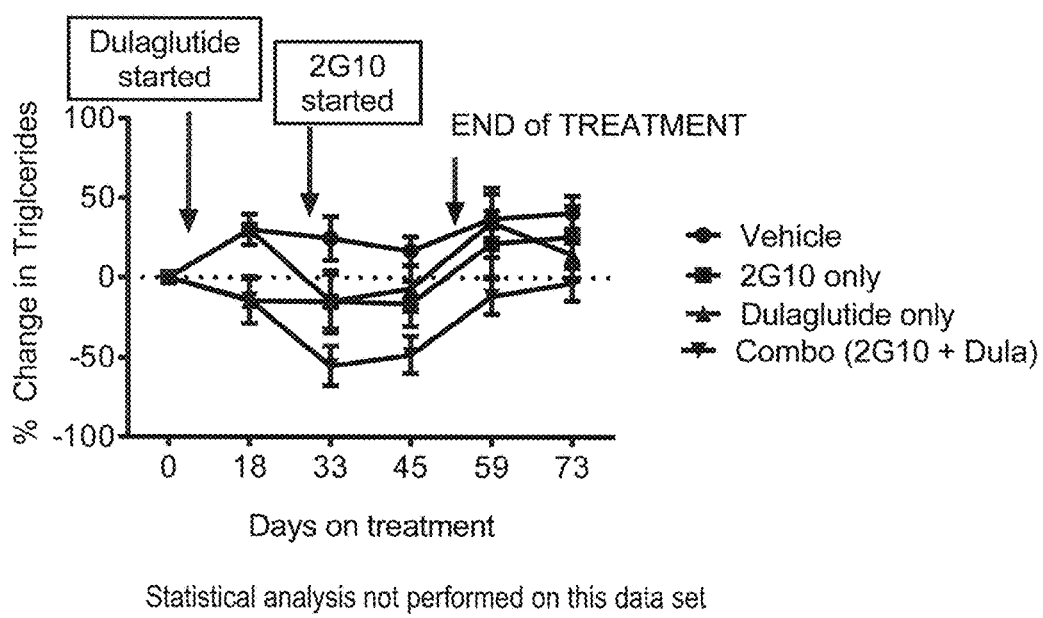
Figure 52A:
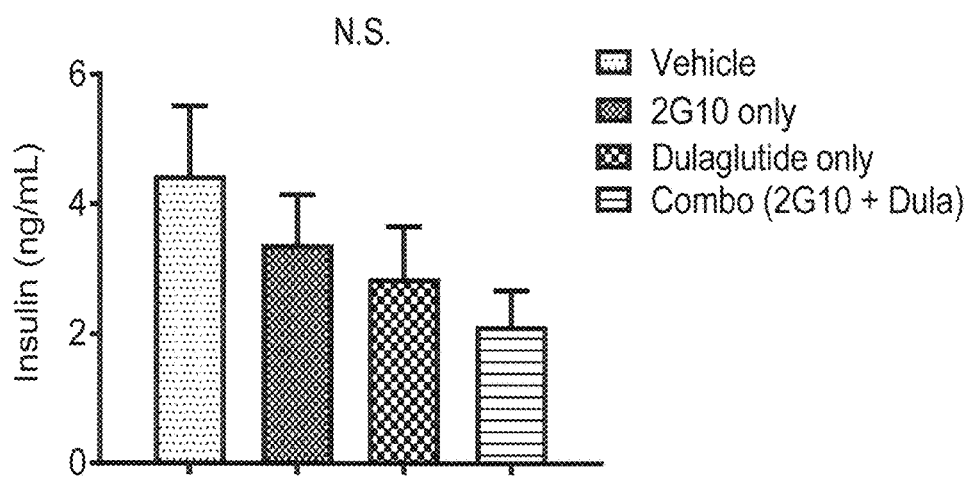
FIG. 52A-52D. 2G10 prevents increase in insulin levels ((FIG. 52A) insulin (ng/mL) and (FIG. 52B) percent in insulin) and reduces triglycerides levels ((FIG. 52C) triglycerides (mg/mL) and (FIG. 52D) percent in triglycerides) with or without Dulaglutide in overnight fasted spontaneously obese cynomolgus monkeys (raw data) post treatment phase (day 45).
Figure 52B:
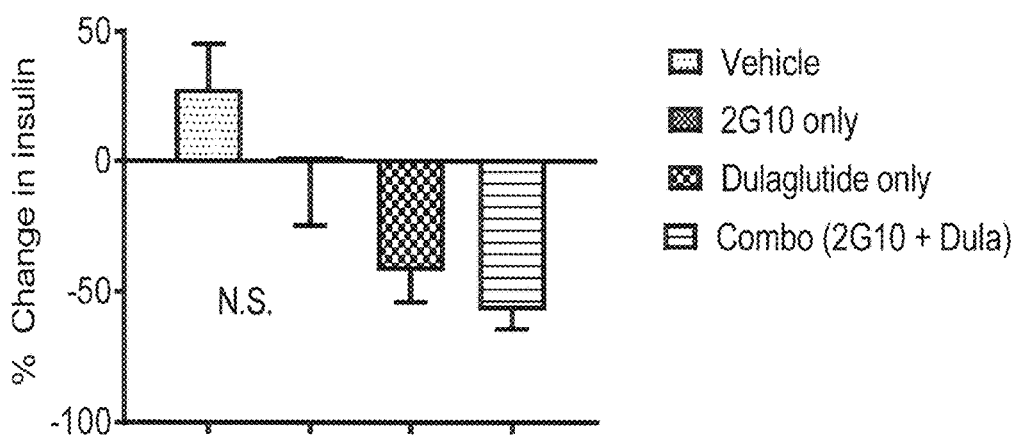
Figure 52C:
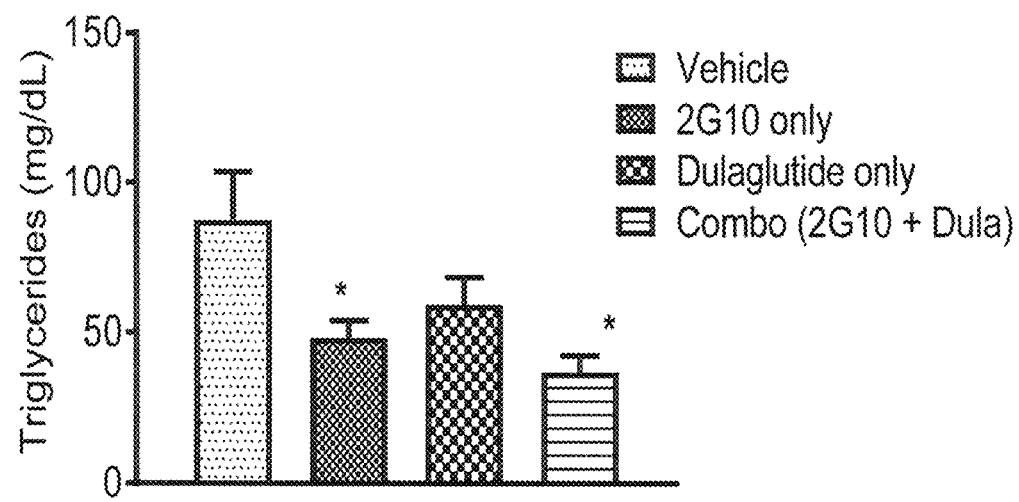
Figure 52D:
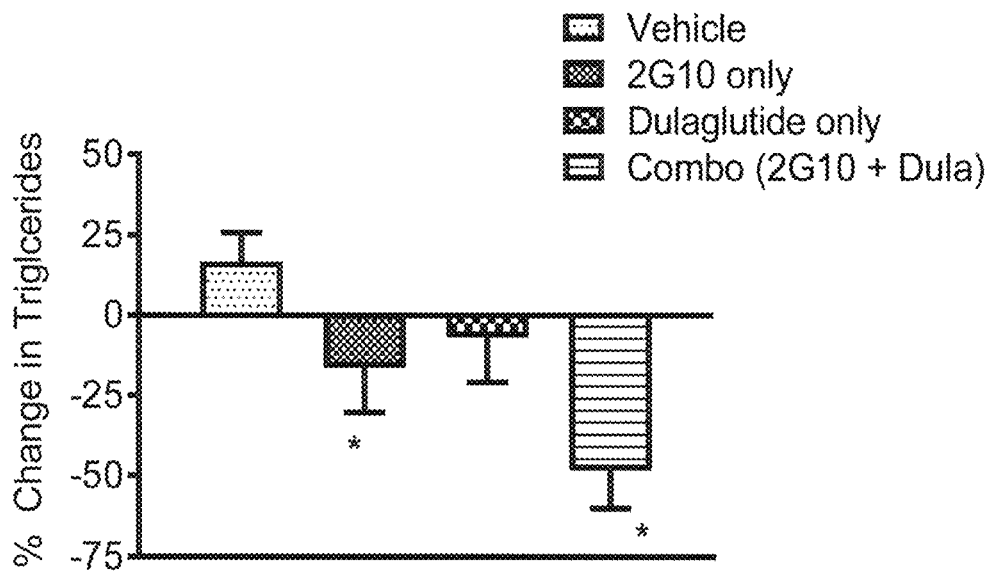
Figure 53A:
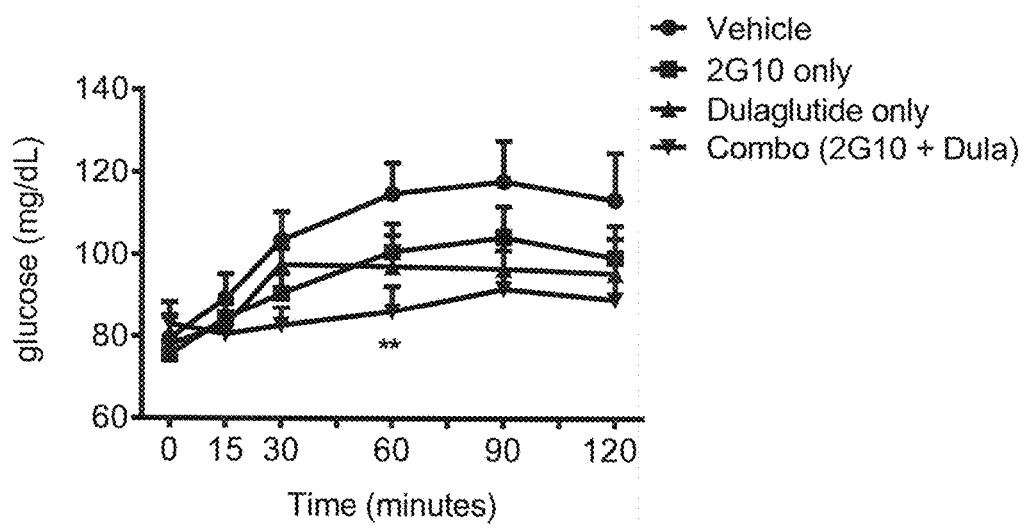
FIG. 53A-53D. 2G10 did not worsen OGTT in overnight fasted spontaneously obese cynomolgus monkeys with or without Dulaglutide post treatment phase (day 49)
Figure 53B:
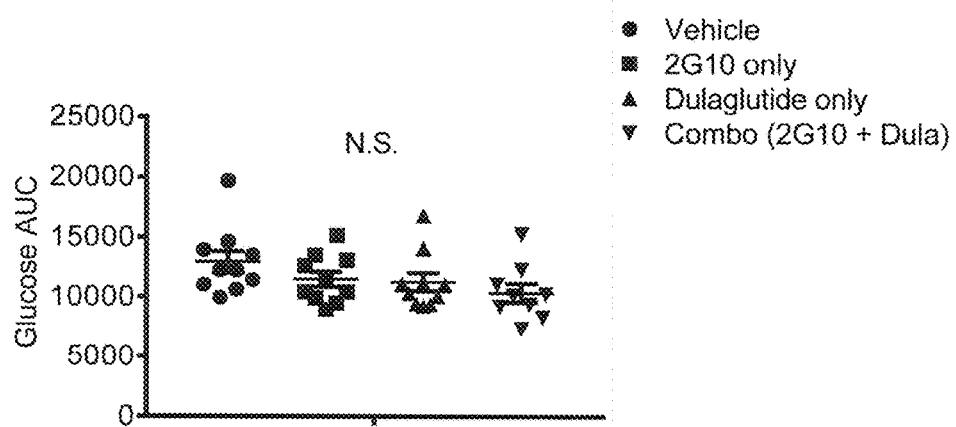
Figure 53C:
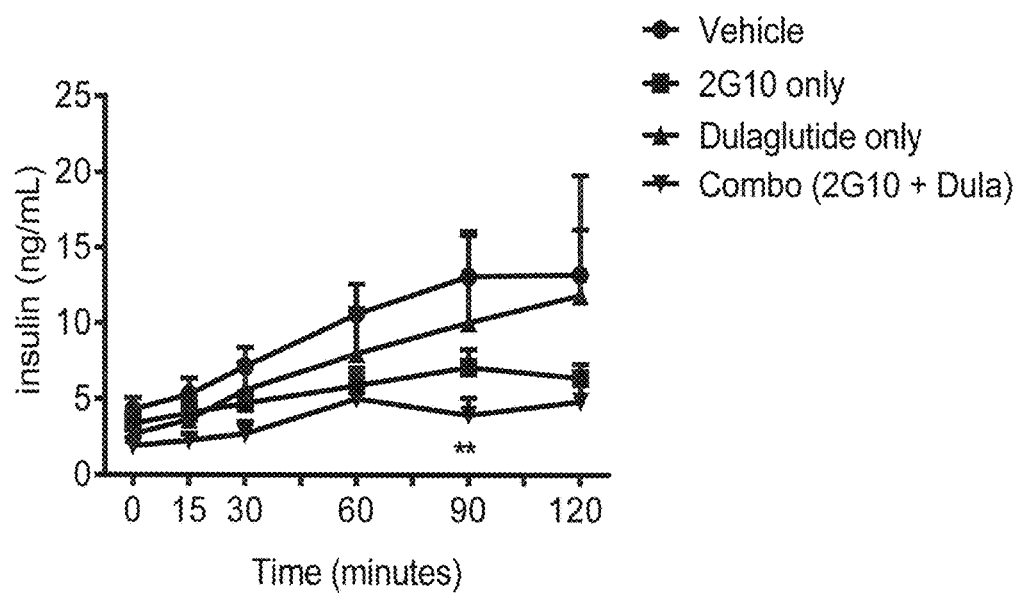
Figure 53D:
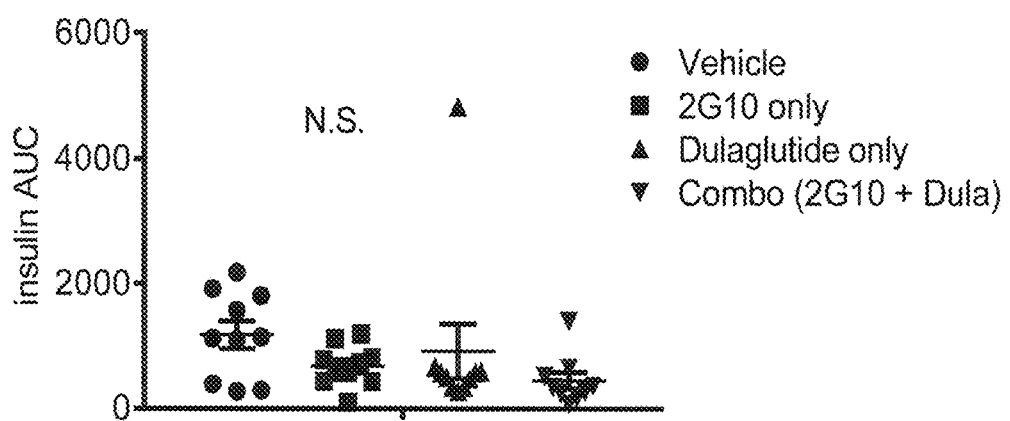
Figure 54A:
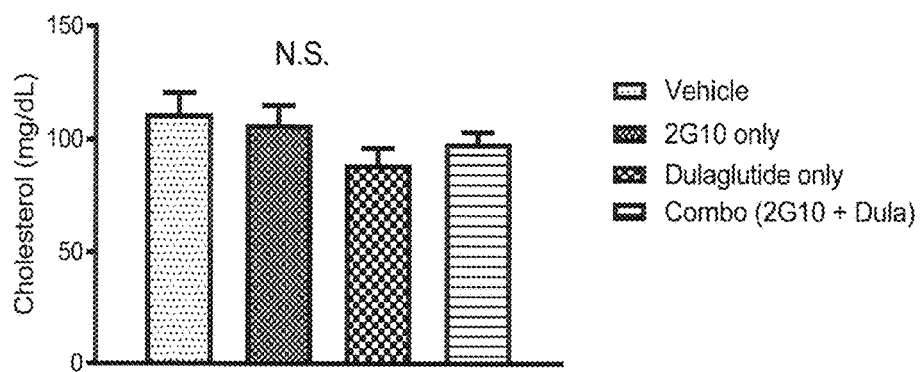
FIG. 54A-54C. 2G10 had no effects on (FIG. 54A) total cholesterol, (FIG. 54B) LDL-C and (FIG. 54C) HDL-C levels in overnight fasted spontaneously obese cynomolgus monkeys post treatment phase (day 45).
Figure 54B:
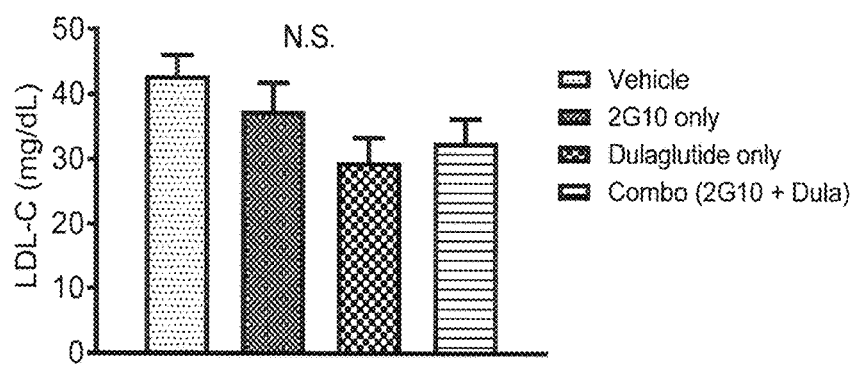
Figure 54C:
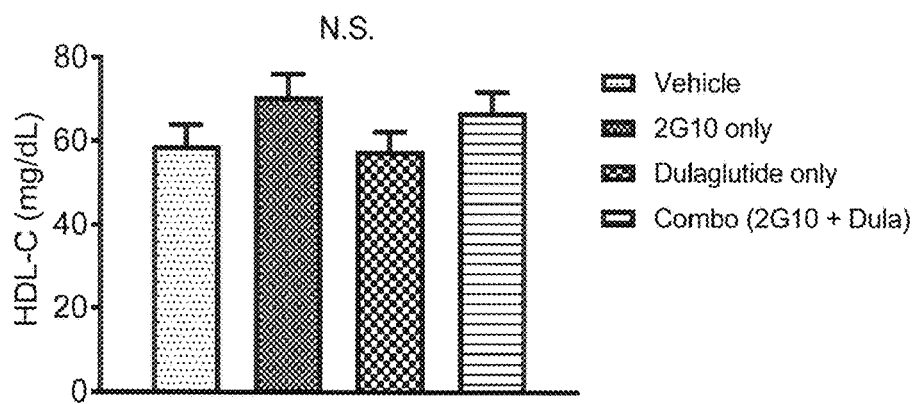
Figure 55:
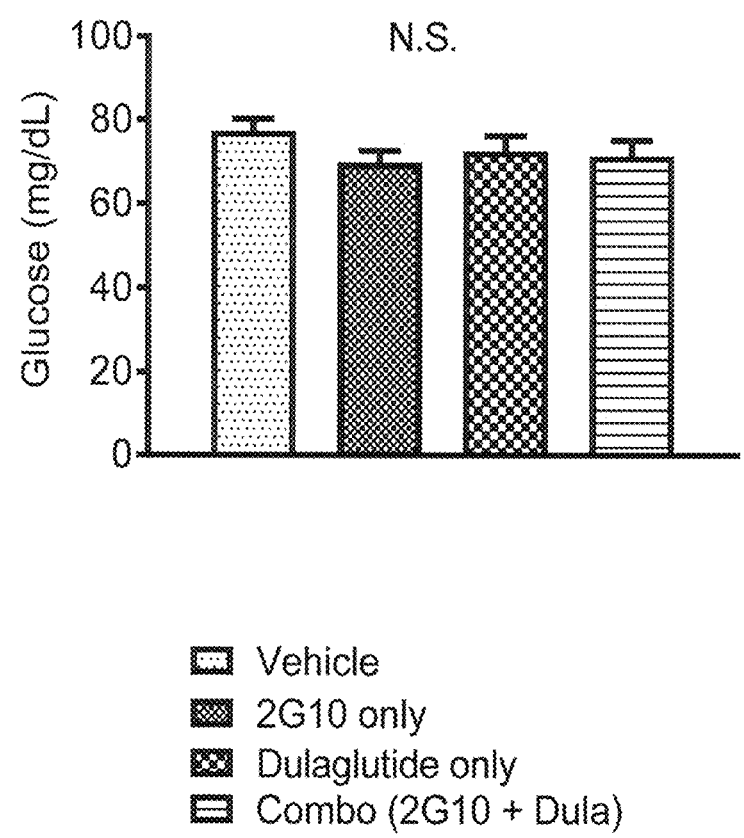
FIG. 55. 2G10 had no effects on glucose levels in overnight fasted normoglycemic obese cynomolgus monkeys post treatment phase (day 45).
Figure 56A:
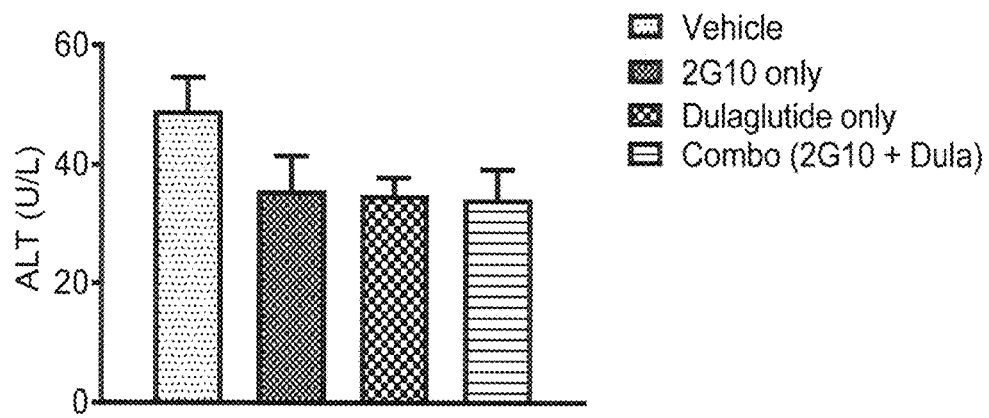
FIG. 56A-56B. 2G10 had no effects on liver enzymes ((FIG. 56A) ALT and (FIG. 56B) AST) in overnight fasted spontaneously obese cynomolgus monkeys post treatment phase (day 45).
Figure 56B:
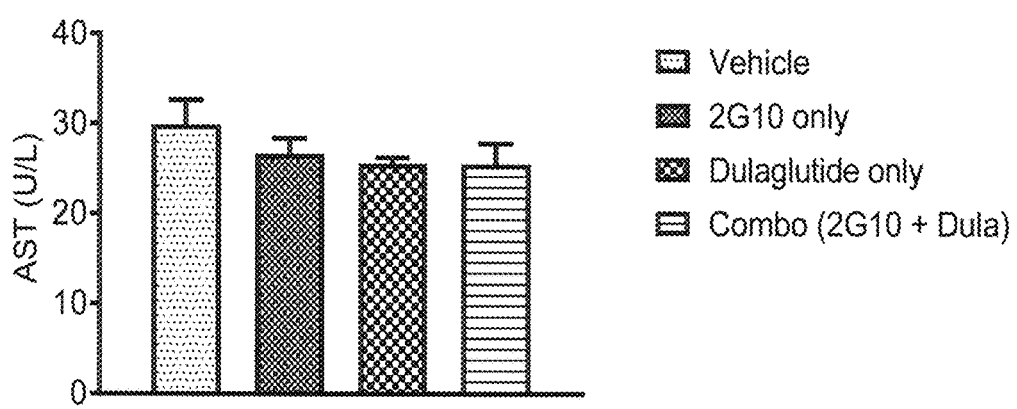

Naïve, male, spontaneously obese cynomolgus monkeys (*Macaca fascicularis*) were acclimated and trained to experimental procedures and were sorted into four final treatment groups of n=10 monkeys each:

Species: *Macaca fascicularis*
Body Weight: >7.0 kg
BMI Range: >41 kg/m$^2$
Age range: 10-15 years
Source: KBI colony
Number and Sex: 40/male Animals were dosed with vehicle, GIPR antagonistic Ab 2G10_LC1.006 ("2G10"), GLP1R agonist dulaglutide, or combination of 2G10_LC1.006 and dulaglutide (co-administration) following specific dosing regimen as shown in FIG. 48.

Dulaglutide was introduced to pertinent groups in a dose loading fashion for 18 days prior to 2G10_LC1.006 treatment. Groups not receiving dulaglutide were treated with dulaglutide buffer during this time.

Main endpoints of study were body weight, food intake and post treatment OGTT. Clinical chemistry parameters were also analyzed (FIGS. 48-57). In nave, spontaneously obese cynomolgus monkeys, weekly treatment with 2G10 for 5 weeks demonstrate a decrease in body weight and fasting triglycerides while also preventing an increase in fasting insulin as well as glucose and insulin AUC during OGTT. Body weight, insulin and triglyceride levels were further decreased in the group of animals treated with 2G10 and Dulaglutide in comparison to the group of animals treated with Dulaglutide only.

EXAMPLE 13

2G10_LC1.006 mAb (hereafter and in figures known as "2G10") was expressed in 293-6E cells. The protein was purified by mAb SelectSure column and further purified on size exclusion column. Purified mAb was cleaved with immobilized papain at 37° C. for 4 hour. The cleaved Fab and Fc were separated by mAb SelectSure column. Fab fragment was polished on size exchange column.

A Caspase 3 cleavage site was engineered in the hinge region for the following antibodies to allow efficient cleavage of Fc: 2C2.005.014 (hereafter and in figures known as "2C2"), 6H1.004 (hereafter and in figures known as "6H1") and 17H11.004.001 (hereafter and in figures known as "17H11"). The antibodies are expressed in 293-6E cells and were purified by mAb Select Sure column. Purified mAb was cleaved with Caspase 3 at 4° C. overnight. The Fc, uncleaved mAb and Caspase 3 were removed by tandem His-Trap and mAb SelectSure column. The Fab fragment was polished on size exchange column.

Human GIPR ECD (amino acid 24-138) and a truncated version of human GIPR ECD (amino acid 24-123) were expressed in *E. coli* as inclusion bodies. The inclusion body was solubilized and refolded. Refolded human GIPR ECD were purified on size exclusion and MonoQ column, and polished on size exclusion column.

1. Complex Purification and Crystallization

The following huGIPR-Fab complexes were formed by mixing Fab fragments and excess molar ratio of huGIPR:
1). human GIPR ECD (24-138) with Fab 2G10,
2). human GIPR ECD (24-138) with Fab 2C2,
3). human GIPR ECD (24-138) with Fab 6H1,
4). human GIPR ECD (24-123) with Fab 17H11.

The complexes were incubated on ice for 30 minutes and purified on Supderdex 75 16/600 column. Purified complexes were concentrated to 10-15 mg/ml and screened against commercial high throughput crystallization screens. Crystals were observed under following conditions for each complex:

huGIPR ECD (24-138) with Fab2G10: 10% PEG4000 and 20% isopropanol.

huGIPR ECD (24-138) with Fab2C2: 20-35% PEG4000, 0.2 M MgCl2, 0.1 M Hepes or Tris pH 7.0-8.5, huGIPR ECD (24-138) with Fab 6H1: 20% PEG4000, 0.1 M Na Citrate, pH 5.5 18% isopropanol huGIPR ECD (24-123) with Fab17H11: 20% PEG4000, 18-20% isopropanol, 0.1 M Na Citrate pH 5.5 or 0.1 M MES, pH 6.0

2. Data Collection and Structure Solution

The crystals were flash frozen in liquid nitrogen with either 25% glycerol supplemented to the well solution or oil as cryo-protectant. High-resolution datasets were collected at the Advanced Light Source, Lawrence Berkeley National Lab (Berkeley, Calif.) and Advanced Photon Source, Argonne National lab (Chicago, Ill.). The data was processed with XDS and scaled using AIMLESS in CCP4 program suite. The structure was solved by molecular replacement method with program PHASER using published huGIPR ECD domain structure (PDB code: 4HJ0) and the constant and variable domain of the Fab structure (Amgen internal data) as search model. Iterative structure refinement was carried out with REFMACS in CCP4 or Phenix.refine and model building is performed in COOT.

The interface analysis was carried out with program PISA, AREAMOL and NCONTACT in CCP4 package. The figures were prepared with Pymol.

3. Results

Figure 57A:
FIG. 57A-57B. Overall structure of the huGIPR-Fab 2G10 complex.
Figure 57B:
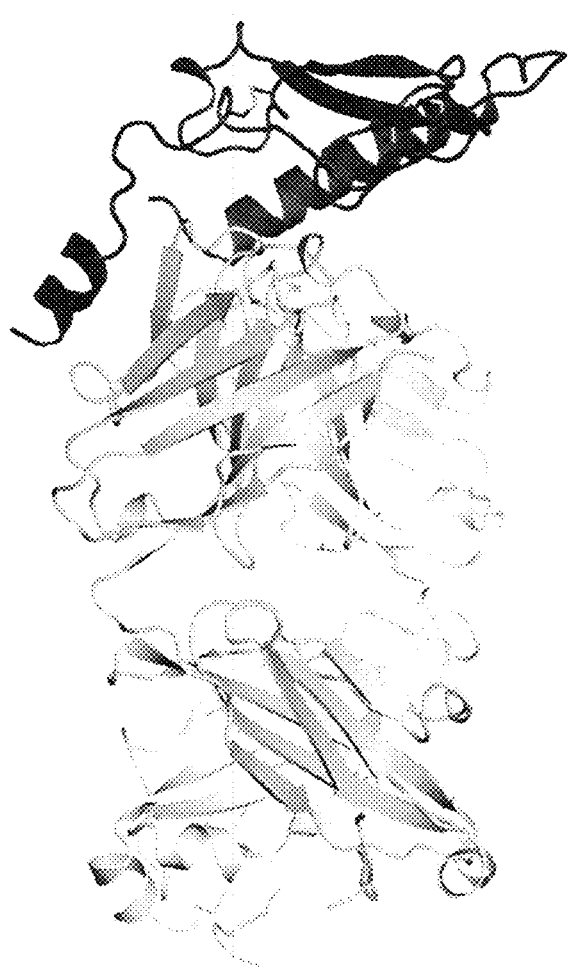
Figure 58A:
FIG. 58A-58B. Binding interface.
Figure 58B:

A. Overall Structure of huGIPR-Fab Complexes huGIPR-Fab 2G10 complex was crystallized and the structure solved at 1.9 Å resolution. There are two pairs of huGIPR-Fab 2G10 complexes in the asymmetric unit (FIG. 57). Each complex consists of one huGIPR ECD molecule and one Fab 2G10 fragment. The huGIPR molecule adopts a typical αββα fold that is similar to other class B GPCR ECD domains, such as GCGR and GLP1R. The Fab 2G10 utilizes all six CDR loops of the heavy chain and light chain to interact with the huGIPR ECD domain (FIG. 58A). The interface on huGIPR ECD includes α1, β1-β2 loop, β3-β4 loop, β4-αC loop and αC. Note that the αC segment is disordered in previously solved GIPR-GIP complex structure. The buried solvent accessible surface area on huGIPR is 1184 Å$^2$, of which 917 Å$^2$ is contributed by the 2G10 heavy chain and 267 Å$^2$ by the light chain.

Figure 59A:
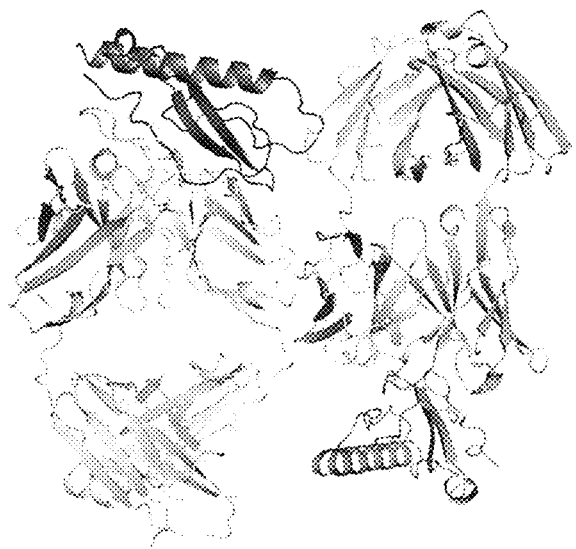
FIG. 59A-59B. Overall structure of the huGIPR-Fab 2C2 complex.
Figure 59B:
Figure 60A:
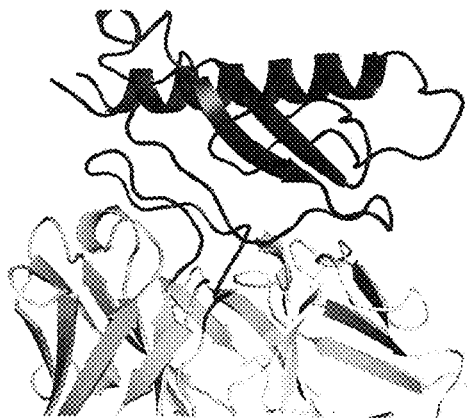
FIG. 60A-60B. Binding interface.
Figure 60B:

The cocrystal structure of huGIPR-Fab 2C2 complex was solved at 2.3 Å resolution. There are two pairs of huGIPR-Fab 2C2 complexes in the asymmetric unit (FIG. 59). Each complex consists of one huGIPR ECD molecule and one Fab 2C2 fragment. The Fab 2C2 utilizes CDR H1 and H3 of the heavy chain and CDR L2 of the light chain to interact with the huGIPR ECD domain (FIG. 60A). The interface on the huGIPR ECD domain includes al, β1-β2 loop, β3-β4 loop, and the long loop after β4. The αC helix is disordered in the huGIPR-Fab 2C2 complex (FIG. 60B). The total buried solvent accessible surface area between huGIPR and Fab 2C2 is 1078 Å$^{2t}$ of which 806 Å$^2$ is contributed by the 2C2 heavy chain and 272 Å$^2$ by the light chain.

Figure 61:
FIG. 61. Overall structure of the huGIPR-Fab 6H1 complex. The Fab molecule is shown in cartoon representation and colored in white and cyan for light chain and heavy chain combination. The huGIPR domain is shown in magenta.
Figure 62A:
FIG. 62A-62B. Binding interface.
Figure 62B:
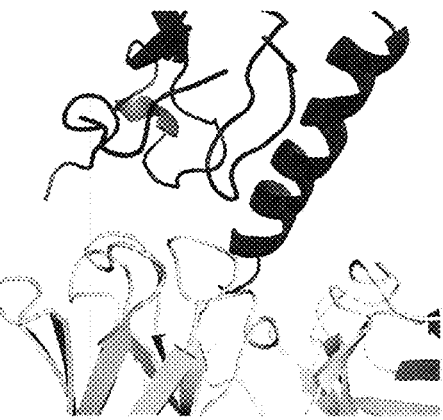

The complex structure of huGIPR-Fab 6H1 was solved at 2.65 Å resolution. There is one pair of huGIPR-Fab 6H1 complex in the asymmetric unit (FIG. 61). The Fab 6H1 utilizes all six CDR loops of the heavy chain and light chain to interact with the huGIPR ECD domain (FIG. 62A). The interface on the huGIPR ECD domain includes αl, β1-β2 loop, β3-β4 loop, and small part of the loop after β4 (FIG. 62B). The αC helix is disordered in the huGIPR-Fab 6H1 complex. The total buried solvent accessible surface area between huGIPR and Fab 6H1 is 784 Å$^2$, of which 505 Å$^2$ is contributed by the Fab 6H1 heavy chain and 279 Å$^2$ by the light chain.

Figure 63:
FIG. 63. Overall structure of the huGIPR-Fab 17H11 complex. The Fab molecule is shown in cartoon representation and colored in white and cyan for light chain and heavy chain combination. The huGIPR domain is shown in magenta.
Figure 64A:
FIG. 64A-64B. Binding interface.
Figure 64B:
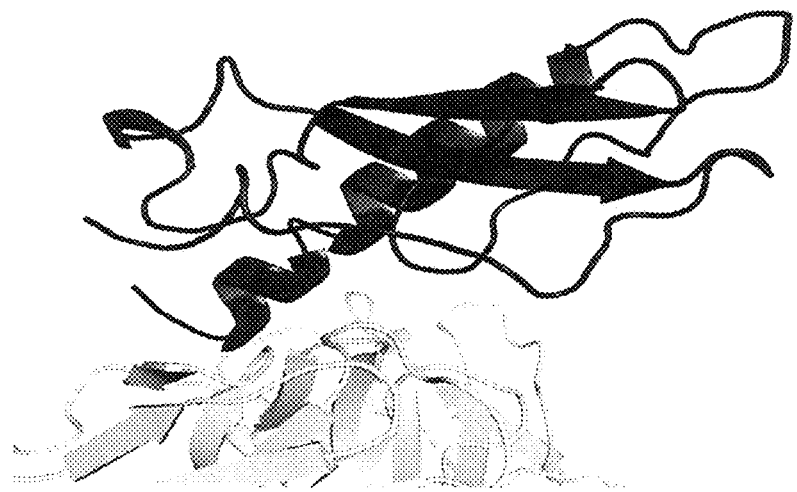
Figure 65A:
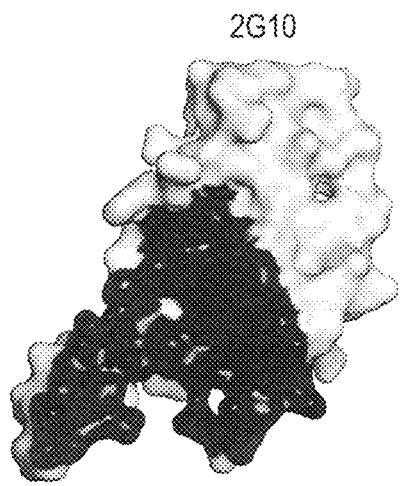
FIG. 65A-65E. Surface representation of antibody epitope. The GIPR ECD domain is shown in pink surface representation. The epitope for the four antibodies, (FIG. 65A) 2G10, (FIG. 65B) 2C2, (FIG. 65C) 6H1 and (FIG. 65D) 17H11, are highlighted in blue, green, cyan and orange respectively.
Figure 65B:
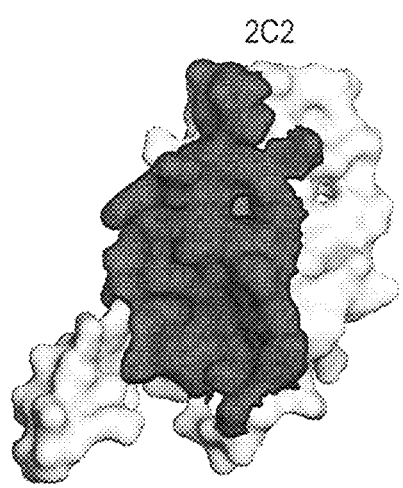
Figure 65C:
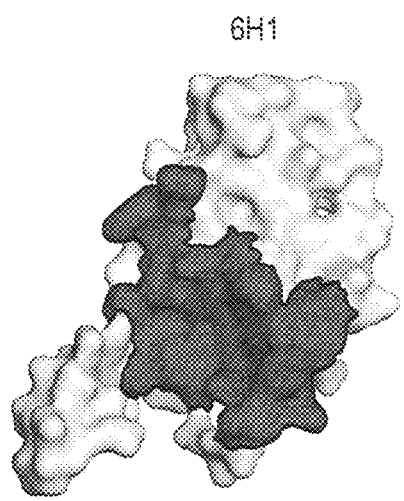
Figure 65D:
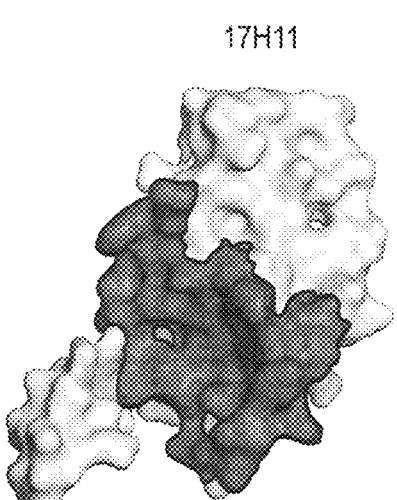
Figure 65E:
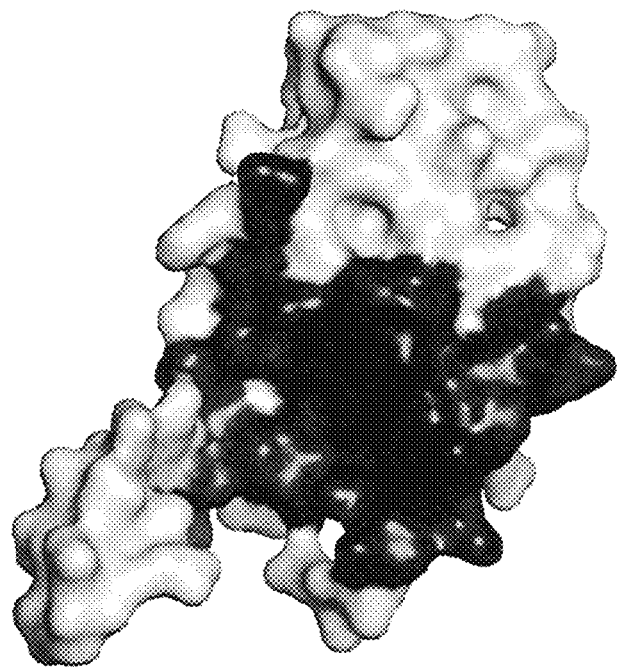

The complex structure of huGIPR-Fab 17H11 was solved at 1.6 Å resolution. There is one pair of huGIPR-Fab 17H11 complex in the asymmetric unit (FIG. 63). The Fab 17H11 utilizes all six CDR loops of the heavy chain and light chain to interact with the huGIPR ECD domain (FIG. 64A). The interface on the huGIPR ECD domain includes α1, β1-β2 loop, β3-β4 loop, and part of the loop after β4. The total buried solvent accessible surface area between huGIPR and Fab 17H11 is 739 Å$^2$, of which 299 Å$^2$ is contributed by the Fab 17H11 heavy chain and 440 Å$^2$ by the light chain.

B. The Interface Analysis

Two different methods were used to define the interface residues. In the first method the interface residues were defined using solvent exposure difference. The solvent accessible surface area (ASA) was calculated for each residue in huGIPR ECD domain in the complex and compared to the solvent accessible surface area of the corresponding residue stripped from complex. All amino acids with different ASA are considered interface residues.

In the second method, interface residues were selected that have at least one atom within a predefined distance to its partner protein. Two shells were defined based on the distance.

1) Core interaction shell includes all residues with distance shorter than 5.0 Å.

2) Boundary shell includes all residues with distance longer than 5.0 Å, but shorter than 8.0 Å to the partner protein.

The complete list of amino acid residues for human GIPR ECD that interact with four Fabs are list in the following tables.

Table 10. GIPR ECD epitope residues in GIPR-Fab 2G10 complex defined by solvent exposure differences and distance cutoff method.

Table 11. GIPR ECD epitope residues in GIPR-Fab 2C2 complex defined by solvent exposure differences and distance cutoff method.

Table 12. GIPR ECD epitope residues in GIPR-Fab 6H1 complex defined by solvent exposure differences and distance cutoff method.

Table 13: GIPR ECD epitope residues in GIPR-Fab 17H11 complex defined by solvent exposure differences and distance cutoff method.

Important residues on the human GIPR ECD that form either hydrogen bond or salt bridge interactions with Fab are summarized in Table 14.

Using similar methods, we defined the paratope residues for each of the antibodies and summarized the results in the following tables.

Table 15: Fab 2G10 paratope residues defined by solvent exposure differences and distance cutoff method.

Table 16: Fab 2C2 paratope residues defined by solvent exposure differences and distance cutoff method.

Table 17: Fab 6H1 paratope residues defined by solvent exposure differences and distance cutoff method.

Table 18: Fab 17H11 paratope residues defined by solvent exposure differences and distance cutoff method.

The epitope of the Gipg013 antibody (Structural and Pharmacological Characterization of Novel Potent and Selective Monoclonal Antibody Antagonists of Glucose-dependent Insulinotropic Polypeptide Receptor. Ravn, et al. J Biol Chem. 2013 Jul. 5; 288(27):19760-72.) was analyzed from the published structure 4HJ0 using the same methods. The results are summarized in table 19.

FIG. 65 highlights the epitope of the four antibodies (2G10, 2C2, 6H1 and 17H11) and the previously published antibody Gipg013 (PDB 4HJ0) on the human GIPR ECD domain surface.

The high-resolution crystal structure has allowed identification of the interface between huGIPR ECD and four antibodies. Using two different methods, the specific amino acid residues involved in the recognition were mapped. The spatial requirement and the nature of the interaction for every interface residue are elucidated.

TABLE 10

GIPR ECD epitope residues in GIPR-Fab 2G10 complex defined by solvent exposure differences and distance cutoff method.

| GIPR residues within 5A of 2G10 | | GIPR residues with 8A of 2G10 | | GIPR residue identified by ASA difference | |
|---|---|---|---|---|---|
| 30 | GLN | 29 | GLY | 30 | GLN |
| 31 | THR | 30 | GLN | 31 | THR |
| 32 | ALA | 31 | THR | 32 | ALA |
| 33 | GLY | 32 | ALA | 33 | GLY |
| 34 | GLU | 33 | GLY | 34 | GLU |
| 35 | LEU | 34 | GLU | 35 | LEU |
| 36 | TYR | 35 | LEU | 36 | TYR |
| 37 | GLN | 36 | TYR | 37 | GLN |
| 39 | TRP | 37 | GLN | 39 | TRP |
| 66 | ASP | 38 | ARG | 66 | ASP |
| 67 | MET | 39 | TRP | 67 | MET |
| 68 | TYR | 40 | GLU | 68 | TYR |
| 87 | TYR | 43 | ARG | 87 | TYR |
| 88 | LEU | 65 | PHE | 88 | LEU |
| 89 | PRO | 66 | ASP | 89 | PRO |
| 90 | TRP | 67 | MET | 90 | TRP |
| 101 | ARG | 68 | TYR | 101 | ARG |
| 113 | ARG | 69 | VAL | 113 | ARG |
| 115 | HIS | 71 | TRP | 115 | HIS |
| 119 | GLU | 85 | PRO | 119 | GLU |
| 123 | LYS | 87 | TYR | 120 | ASN |
| 125 | GLU | 88 | LEU | 123 | LYS |
| 128 | LEU | 89 | PRO | 125 | GLU |
| 129 | ASP | 90 | TRP | 128 | LEU |
| 132 | ARG | 101 | ARG | 129 | ASP |
| 133 | LEU | 111 | LEU | 132 | ARG |
| | | 112 | TRP | 133 | LEU |
| | | 113 | ARG | | |
| | | 115 | HIS | | |
| | | 116 | THR | | |
| | | 118 | CYS | | |
| | | 119 | GLU | | |
| | | 120 | ASN | | |
| | | 122 | GLU | | |
| | | 123 | LYS | | |
| | | 124 | ASN | | |
| | | 125 | GLU | | |
| | | 126 | ALA | | |
| | | 128 | LEU | | |
| | | 129 | ASP | | |
| | | 130 | GLN | | |
| | | 131 | ALA | | |
| | | 132 | ARG | | |

TABLE 10-continued

GIPR ECD epitope residues in GIPR-Fab 2G10 complex defined by solvent exposure differences and distance cutoff method.

| GIPR residues within 5A of 2G10 | GIPR residues with 8A of 2G10 | GIPR residue identified by ASA difference |
|---|---|---|
| | 133 | LEU |
| | 134 | ILE |

TABLE 11

GIPR ECD epitope residues in GIPR-Fab 2C2 complex defined by solvent exposure differences and distance cutoff method.

| GIPR residue within 5 A of 2C2 | | GIPR residue within 8 A of 2C2 | | GIPR residue identified by ASA difference | |
|---|---|---|---|---|---|
| 31 | THR | 30 | GLN | 32 | ALA |
| 32 | ALA | 31 | THR | 35 | LEU |
| 35 | LEU | 32 | ALA | 36 | TYR |
| 36 | TYR | 33 | GLY | 39 | TRP |
| 39 | TRP | 34 | GLU | 62 | ASN |
| 62 | ASN | 35 | LEU | 64 | SER |
| 64 | SER | 36 | TYR | 65 | PHE |
| 65 | PHE | 39 | TRP | 66 | ASP |
| 66 | ASP | 40 | GLU | 67 | MET |
| 67 | MET | 43 | ARG | 68 | TYR |
| 68 | TYR | 47 | GLN | 87 | TYR |
| 71 | TRP | 60 | ALA | 88 | LEU |
| 87 | TYR | 61 | CYS | 89 | PRO |
| 88 | LEU | 62 | ASN | 90 | TRP |
| 89 | PRO | 63 | GLY | 101 | ARG |
| 90 | TRP | 64 | SER | 104 | GLY |
| 101 | ARG | 65 | PHE | 105 | SER |
| 104 | GLY | 66 | ASP | 106 | ASP |
| 105 | SER | 67 | MET | 108 | GLN |
| 106 | ASP | 68 | TYR | 109 | TRP |
| 108 | GLN | 69 | VAL | 110 | GLY |
| 109 | TRP | 71 | TRP | 111 | LEU |
| 110 | GLY | 77 | ASN | 112 | TRP |
| 111 | LEU | 85 | PRO | 113 | ARG |
| 112 | TRP | 87 | TYR | 114 | ASP |
| 113 | ARG | 88 | LEU | 115 | HIS |
| 114 | ASP | 89 | PRO | 116 | THR |
| 115 | HIS | 90 | TRP | 118 | CYS |
| 116 | THR | 99 | VAL | 119 | GLU |
| 119 | GLU | 100 | LEU | 120 | ASN |
| | | 101 | ARG | | |
| | | 102 | GLN | | |
| | | 103 | CYS | | |
| | | 104 | GLY | | |
| | | 105 | SER | | |
| | | 106 | ASP | | |
| | | 107 | GLY | | |
| | | 108 | GLN | | |
| | | 109 | TRP | | |
| | | 110 | GLY | | |
| | | 111 | LEU | | |
| | | 112 | TRP | | |
| | | 113 | ARG | | |
| | | 114 | ASP | | |
| | | 115 | HIS | | |
| | | 116 | THR | | |
| | | 117 | GLN | | |
| | | 118 | CYS | | |
| | | 119 | GLU | | |
| | | 120 | ASN | | |
| | | 121 | PRO | | |

TABLE 12

GIPR ECD epitope residues in GIPR-Fab 6H1 complex defined by solvent exposure differences and distance cutoff method.

| GIPR residues within 5 A of 6H1 | | GIPR residues within 8 A of 6H1 | | GIPR residues identified by ASA difference | |
|---|---|---|---|---|---|
| 32 | ALA | 32 | ALA | 32 | ALA |
| 33 | GLY | 33 | GLY | 33 | GLY |
| 34 | GLU | 34 | GLU | 34 | GLU |
| 36 | TYR | 35 | LEU | 35 | LEU |
| 37 | GLN | 36 | TYR | 36 | TYR |
| 40 | GLU | 37 | GLN | 37 | GLN |
| 43 | ARG | 38 | ARG | 39 | TRP |
| 35 | LEU | 39 | TRP | 40 | GLU |
| 39 | TRP | 40 | GLU | 43 | ARG |
| 66 | ASP | 43 | ARG | 66 | ASP |
| 67 | MET | 67 | MET | 67 | MET |
| 87 | TYR | 65 | PHE | 68 | TYR |
| 88 | LEU | 66 | ASP | 87 | TYR |
| 89 | PRO | 68 | TYR | 88 | LEU |
| 90 | TRP | 85 | PRO | 89 | PRO |
| 111 | LEU | 87 | TYR | 90 | TRP |
| 112 | TRP | 88 | LEU | 111 | LEU |
| 115 | HIS | 89 | PRO | 112 | TRP |
| 119 | GLU | 90 | TRP | 113 | ARG |
| 120 | ASN | 111 | LEU | 115 | HIS |
| | | 112 | TRP | 118 | CYS |
| | | 113 | ARG | 119 | GLU |
| | | 114 | ASP | 120 | ASN |
| | | 115 | HIS | | |
| | | 118 | CYS | | |
| | | 119 | GLU | | |
| | | 120 | ASN | | |
| | | 121 | PRO | | |

TABLE 13

GIPR ECD epitope residues in GIPR-Fab 17H11 complex defined by solvent exposure differences and distance cutoff method.

| GIPR residues within 5 A of 17H11 | | GIPR residues within 8 A of 17H11 | | GIPR residues identified by ASA difference | |
|---|---|---|---|---|---|
| 30 | GLN | 30 | GLN | 30 | GLN |
| 31 | THR | 31 | THR | 31 | THR |
| 32 | ALA | 32 | ALA | 32 | ALA |
| 33 | GLY | 33 | GLY | 33 | GLY |
| 35 | LEU | 34 | GLU | 34 | GLU |
| 36 | TYR | 35 | LEU | 35 | LEU |
| 37 | GLN | 36 | TYR | 36 | TYR |
| 39 | TRP | 37 | GLN | 37 | GLN |
| 40 | GLU | 38 | ARG | 39 | TRP |
| 43 | ARG | 39 | TRP | 40 | GLU |
| 66 | ASP | 40 | GLU | 43 | ARG |
| 67 | MET | 43 | ARG | 66 | ASP |
| 68 | TYR | 65 | PHE | 67 | MET |
| 87 | TYR | 66 | ASP | 68 | TYR |
| 88 | LEU | 67 | MET | 87 | TYR |
| 89 | PRO | 68 | TYR | 88 | LEU |
| 90 | TRP | 69 | VAL | 89 | PRO |
| 113 | ARG | 71 | TRP | 90 | TRP |
| 115 | HIS | 85 | PRO | 111 | LEU |
| 119 | GLU | 87 | TYR | 112 | TRP |
| | | 88 | LEU | 113 | ARG |
| | | 89 | PRO | 114 | ASP |
| | | 90 | TRP | 115 | HIS |
| | | 99 | VAL | 116 | THR |
| | | 101 | ARG | 119 | GLU |
| | | 111 | LEU | 120 | ASN |
| | | 113 | ARG | | |
| | | 114 | ASP | | |
| | | 115 | HIS | | |
| | | 116 | THR | | |
| | | 118 | CYS | | |

TABLE 13-continued

GIPR ECD epitope residues in GIPR-Fab 17H11 complex defined by solvent exposure differences and distance cutoff method.

| GIPR residues within 5 Å of 17H11 | GIPR residues within 8 Å of 17H11 | GIPR residues identified by ASA difference | |
|---|---|---|---|
| | 119 | GLU | |
| | 120 | ASN | |

TABLE 14

List of interface residue interactions

Interactions between Fab 2G10 heavy chain and huGIPR

Hydrogen bond interactions

| huGIPR | Dist. | 2G10 HC |
|---|---|---|
| TYR 36 [OH] | 2.8 | GLN 100 [OE1] |
| ARG 113 [NH1] | 3.1 | ASN 31 [OD1] |
| ARG 113 [NH2] | 3.1 | SER 30 [O] |
| LYS 123 [NZ] | 2.9 | ASP 54 [O] |
| ARG 132 [NH2] | 3.2 | LYS 58 [O] |

Salt Bridges

| huGIPR | Dist. | 2G10 HC |
|---|---|---|
| HIS 115 [NE2] | 3.0 | ASP 54 [OD2] |
| GLU 125 [OE1] | 3.4 | LYS 58 [NZ] |
| ASP 129 [OD1] | 2.9 | LYS 58 [NZ] |
| ASP 129 [OD2] | 3.1 | LYS 58 [NZ] |

Interactions between Fab 2G10 light chain and huGIPR

Hydrogen Bonds

| huGIPR | Dist. | 2G10 LC |
|---|---|---|
| ALA 32 [N] | 3.4 | ASN 93 [OD1] |
| ALA 32 [N] | 3.0 | ASN 92 [O] |
| GLY 33 [N] | 2.4 | ASN 92 [O] |
| GLN 37 [OE1] | 3.2 | ASN 32 [ND2] |

TABLE 14-continued

List of interface residue interactions

Interactions between Fab 2C2 heavy chain and huGIPR

Hydrogen Bonds

| huGIPR | Dist. | 2C2 HC |
|---|---|---|
| ARG 113 [O] | 3.3 | TYR 32 [OH] |
| LEU 111 [O] | 3.5 | ARG 98 [NH2] |
| ASP 66 [OD2] | 2.7 | TYR 113 [OH] |
| ARG 113 [NH2] | 2.6 | GLY 100 [O] |

Interactions between Fab 2C2 light chain and huGIPR

Hydrogen Bonds

| huGIPR | Dist. | 2C2 LC |
|---|---|---|
| SER 57 [OG] | 3.1 | ASP 106 [OD1] |
| GLY 58 [N] | 2.8 | ASP 106 [OD2] |
| ARG 55 [NE] | 2.6 | GLN 108 [OE1] |
| TYR 50 [OH] | 3.2 | ARG 101 [NH2] |
| GLN 54 [OE1] | 3.5 | ASN 62 [ND2] |
| PRO 56 [O] | 3.0 | GLN 108 [NE2] |
| VAL 59 [O] | 3.1 | :GLN 108 [NE2] |

Interactions between Fab 6H1 heavy chain and huGIPR

Hydrogen Bonds

| huGIPR | Dist. | 6H1 HC |
|---|---|---|
| LEU 111 [O] | 3.8 | TYR 31 [OH] |

Interactions between Fab 6H1 light chain and huGIPR

| huGIPR | Dist. | 6H1 LC |
|---|---|---|
| GLU 34 [N] | 3.6 | L:ASN 92 [O] |

Interactions between Fab 17H11 heavy chain and huGIPR

Hydrogen Bonds

| huGIPR | Dist. | 17H11 HC |
|---|---|---|
| GLN 37 [NE2] | 3.3 | SER 31 [O] |
| ARG 43 [NH2] | 3.8 | TYR 33 [OH] |
| GLU 40 [OE2] | 3.0 | TYR 33 [OH] |

Interactions between Fab 17H11 light chain and huGIPR

Hydrogen Bonds

| huGIPR | Dist. | 17H11 LC |
|---|---|---|
| ALA 32 [N] | 3.0 | GLN 55 [OE1] |
| GLN 30 [O] | 3.9 | TYR 49 [OH] |

TABLE 15

Fab 2G10 paratope residues defined by solvent exposure differences and distance cutoff method

| 2G10 Heavy Chain | | | 2G10 Light Chain | | |
|---|---|---|---|---|---|
| Distance cutoff 5 Å | Distance cutoff 8 Å | ASA difference | Distance cutoff 5 Å | Distance cutoff 8 Å | ASA difference |
| number residue | number residue | number residue | number residue | number residue | number residue |
| 30 SER | 28 THR | 30 SER | 30 SER | 29 VAL | 30 SER |
| 31 ASN | 29 PHE | 31 ASN | 32 ASN | 30 SER | 31 SER |

TABLE 15-continued

Fab 2G10 paratope residues defined by solvent exposure differences and distance cutoff method

| 2G10 Heavy Chain | | | | | | 2G10 Light Chain | | | | | |
|---|---|---|---|---|---|---|---|---|---|---|---|
| Distance cutoff 5A | | Distance cutoff 8 A | | ASA difference | | Distance cutoff 5A | | Distance cutoff 8 A | | ASA difference | |
| number | residue | number | residue | number | residue | number | residue | number | residue | number | residue |
| 32 | TYR | 30 | SER | 32 | TYR | 49 | TYR | 31 | SER | 32 | ASN |
| 52 | TRP | 31 | ASN | 51 | ILE | 91 | TYR | 32 | ASN | 49 | TYR |
| 53 | PHE | 32 | TYR | 52 | TRP | 92 | ASN | 33 | LEU | 91 | TYR |
| 54 | ASP | 33 | GLY | 53 | PHE | 93 | ASN | 46 | LEU | 92 | ASN |
| 55 | ALA | 50 | ALA | 54 | ASP | 94 | TRP | 49 | TYR | 93 | ASN |
| 56 | SER | 51 | ILE | 55 | ALA | 96 | LEU | 50 | GLY | 94 | TRP |
| 57 | ASP | 52 | TRP | 56 | SER | | | 53 | THR | 96 | LEU |
| 58 | LYS | 53 | PHE | 57 | ASP | | | 90 | GLN | | |
| 59 | TYR | 54 | ASP | 58 | LYS | | | 91 | TYR | | |
| 60 | TYR | 55 | ALA | 59 | TYR | | | 92 | ASN | | |
| 65 | LYS | 56 | SER | 60 | TYR | | | 93 | ASN | | |
| 66 | GLY | 57 | ASP | 65 | LYS | | | 94 | TRP | | |
| 67 | ARG | 58 | LYS | 66 | GLY | | | 95 | PRO | | |
| 69 | THR | 59 | TYR | 67 | ARG | | | 96 | LEU | | |
| 70 | ILE | 60 | TYR | 68 | PHE | | | | | | |
| 71 | SER | 61 | ALA | 69 | THR | | | | | | |
| 84 | ASN | 62 | ASP | 71 | SER | | | | | | |
| 100 | GLN | 64 | VAL | 72 | ARG | | | | | | |
| 101 | ALA | 65 | LYS | 84 | ASN | | | | | | |
| 102 | ILE | 66 | GLY | 100 | GLN | | | | | | |
| 103 | PHE | 67 | ARG | 101 | ALA | | | | | | |
| 105 | VAL | 68 | PHE | 102 | ILE | | | | | | |
| | | 69 | THR | 103 | PHE | | | | | | |
| | | 70 | ILE | 105 | VAL | | | | | | |
| | | 71 | SER | 106 | VAL | | | | | | |
| | | 72 | ARG | | | | | | | | |
| | | 73 | ASP | | | | | | | | |
| | | 74 | ASN | | | | | | | | |
| | | 75 | SER | | | | | | | | |
| | | 82 | GLN | | | | | | | | |
| | | 84 | ASN | | | | | | | | |
| | | 85 | SER | | | | | | | | |
| | | 98 | ARG | | | | | | | | |
| | | 99 | ASP | | | | | | | | |
| | | 100 | GLN | | | | | | | | |
| | | 101 | ALA | | | | | | | | |
| | | 102 | ILE | | | | | | | | |
| | | 103 | PHE | | | | | | | | |
| | | 104 | GLY | | | | | | | | |
| | | 105 | VAL | | | | | | | | |
| | | 106 | VAL | | | | | | | | |
| | | 108 | ASP | | | | | | | | |

TABLE 16

Fab 2C2 paratope residues defined by solvent exposure differences and distance cutoff method

| 2C2 Heavy Chain | | | | | | 2C2 Light Chain | | | | | |
|---|---|---|---|---|---|---|---|---|---|---|---|
| Distance cutoff 5A | | Distance cutoff 8 A | | ASA difference | | Distance cutoff 5A | | Distance cutoff 8 A | | ASA difference | |
| number | residue | number | residue | number | residue | number | residue | number | residue | number | residue |
| 2 | MET | 1 | GLN | 2 | MET | 47 | LEU | 32 | GLN | 47 | LEU |
| 26 | GLY | 2 | MET | 26 | GLY | 50 | TYR | 33 | THR | 50 | TYR |
| 27 | TYR | 25 | SER | 27 | TYR | 54 | GLN | 35 | ASN | 54 | GLN |
| 28 | THR | 26 | GLY | 28 | THR | 55 | ARG | 37 | TYR | 55 | ARG |
| 32 | TYR | 27 | TYR | 30 | THR | 56 | PRO | 46 | LYS | 56 | PRO |
| 98 | ARG | 28 | THR | 32 | TYR | 57 | SER | 47 | LEU | 57 | SER |
| 100 | GLY | 29 | PHE | 98 | ARG | 58 | GLY | 48 | LEU | 58 | GLY |
| 101 | ASP | 30 | THR | 100 | GLY | 59 | VAL | 49 | ILE | 59 | VAL |
| 102 | TYR | 31 | GLY | 101 | ASP | 61 | ASP | 50 | TYR | 61 | ASP |
| 104 | PHE | 32 | TYR | 102 | TYR | | | 51 | THR | | |
| 105 | GLY | 54 | ASN | 104 | PHE | | | 53 | ASN | | |

TABLE 16-continued

Fab 2C2 paratope residues defined by solvent exposure differences and distance cutoff method

| 2C2 Heavy Chain | | | | | | 2C2 Light Chain | | | | | |
|---|---|---|---|---|---|---|---|---|---|---|---|
| Distance cutoff 5A | | Distance cutoff 8 A | | ASA difference | | Distance cutoff 5A | | Distance cutoff 8 A | | ASA difference | |
| number | residue | number | residue | number | residue | number | residue | number | residue | number | residue |
| 107 | TYR | 98 | ARG | 105 | GLY | | | 54 | GLN | | |
| 110 | HIS | 99 | GLY | 107 | TYR | | | 55 | ARG | | |
| 111 | TYR | 100 | GLY | 110 | HIS | | | 56 | PRO | | |
| 112 | TYR | 101 | ASP | 111 | TYR | | | 57 | SER | | |
| 113 | TYR | 102 | TYR | 112 | TYR | | | 58 | GLY | | |
| 116 | ASP | 103 | VAL | 113 | TYR | | | 59 | VAL | | |
| | | 104 | PHE | 116 | ASP | | | 60 | PRO | | |
| | | 105 | GLY | | | | | 61 | ASP | | |
| | | 106 | THR | | | | | 62 | ARG | | |
| | | 107 | TYR | | | | | 63 | PHE | | |
| | | 108 | ARG | | | | | | | | |
| | | 109 | PRO | | | | | | | | |
| | | 110 | HIS | | | | | | | | |
| | | 111 | TYR | | | | | | | | |
| | | 112 | TYR | | | | | | | | |
| | | 113 | TYR | | | | | | | | |
| | | 114 | GLY | | | | | | | | |
| | | 115 | MET | | | | | | | | |
| | | 116 | ASP | | | | | | | | |
| | | 117 | VAL | | | | | | | | |
| | | 118 | TRP | | | | | | | | |

TABLE 17

Fab 6H1 paratope residues defined by solvent exposure differences and distance cutoff method

| 6H1 Heavy Chain | | | | | | 6H1 Light Chain | | | | | |
|---|---|---|---|---|---|---|---|---|---|---|---|
| Distance cutoff 5A | | Distance cutoff 8 A | | ASA difference | | Distance cutoff 5A | | Distance cutoff 8 A | | ASA difference | |
| number | residue | number | residue | number | residue | number | residue | number | residue | number | residue |
| 28 | THR | 26 | GLY | 28 | THR | 32 | TYR | 29 | ILE | 32 | TYR |
| 31 | TYR | 27 | PHE | 30 | SER | 49 | TYR | 30 | ARG | 49 | TYR |
| 32 | PHE | 28 | THR | 31 | TYR | 50 | GLY | 31 | ASP | 50 | GLY |
| 52 | TRP | 29 | PHE | 32 | PHE | 53 | SER | 32 | TYR | 53 | SER |
| 53 | TYR | 30 | SER | 52 | TRP | 55 | GLN | 33 | LEU | 55 | GLN |
| 98 | ARG | 31 | TYR | 53 | TYR | 91 | HIS | 46 | LEU | 91 | HIS |
| 100 | GLY | 32 | PHE | 77 | ASN | 92 | ASN | 48 | ILE | 92 | ASN |
| 101 | THR | 52 | TRP | 98 | ARG | 93 | ASN | 49 | TYR | 93 | ASN |
| 102 | ILE | 53 | TYR | 100 | GLY | 94 | TYR | 50 | GLY | 94 | TYR |
| 103 | PHE | 54 | ASP | 101 | THR | | | 51 | ALA | 96 | PHE |
| 105 | VAL | 56 | SER | 102 | ILE | | | 52 | SER | | |
| 106 | LEU | 57 | ASN | 103 | PHE | | | 53 | SER | | |
| | | 59 | TYR | 105 | VAL | | | 54 | LEU | | |
| | | 74 | ASN | 106 | LEU | | | 55 | GLN | | |
| | | 77 | ASN | 109 | ASP | | | 56 | SER | | |
| | | 98 | ARG | | | | | 90 | GLN | | |
| | | 99 | ASP | | | | | 91 | HIS | | |
| | | 100 | GLY | | | | | 92 | ASN | | |
| | | 101 | THR | | | | | 93 | ASN | | |
| | | 102 | ILE | | | | | 94 | TYR | | |
| | | 103 | PHE | | | | | 96 | PHE | | |
| | | 104 | GLY | | | | | | | | |
| | | 105 | VAL | | | | | | | | |
| | | 106 | LEU | | | | | | | | |
| | | 107 | LEU | | | | | | | | |
| | | 109 | ASP | | | | | | | | |
| | | 110 | TYR | | | | | | | | |

TABLE 18

Fab 17H11 paratope residues defined by solvent exposure differences and distance cutoff method

| 17H11 Heavy Chain | | | | | | 17H11 Light Chain | | | | | |
|---|---|---|---|---|---|---|---|---|---|---|---|
| Distance cutoff 5A | | Distance cutoff 8 A | | ASA difference | | Distance cutoff 5A | | Distance cutoff 8 A | | ASA difference | |
| number | residue | number | residue | number | residue | number | residue | number | residue | number | residue |
| 31 | SER | 30 | SER | 31 | SER | 30 | ILE | 27 | GLN | 30 | ILE |
| 32 | TYR | 31 | SER | 32 | TYR | 31 | ILE | 28 | GLY | 31 | ILE |
| 33 | TYR | 32 | TYR | 33 | TYR | 32 | TRP | 29 | LEU | 32 | TRP |
| 52 | TYR | 33 | TYR | 52 | TYR | 46 | LEU | 30 | ILE | 46 | LEU |
| 97 | ARG | 52 | TYR | 97 | ARG | 49 | TYR | 31 | ILE | 49 | TYR |
| 98 | ASP | 97 | ARG | 98 | ASP | 52 | SER | 32 | TRP | 50 | ALA |
| 99 | VAL | 98 | ASP | 99 | VAL | 53 | SER | 34 | ALA | 52 | SER |
| 100 | ALA | 99 | VAL | 100 | ALA | 54 | LEU | 46 | LEU | 53 | SER |
| 101 | VAL | 100 | ALA | 101 | VAL | 55 | GLN | 47 | LEU | 54 | LEU |
| 102 | ALA | 101 | VAL | 102 | ALA | 56 | SER | 48 | ILE | 55 | GLN |
| 105 | ASP | 102 | ALA | 105 | ASP | 67 | SER | 49 | TYR | 56 | SER |
| | | 103 | GLY | | | 91 | THR | 50 | ALA | 66 | GLY |
| | | 104 | PHE | | | 92 | ASN | 51 | ALA | 67 | SER |
| | | 105 | ASP | | | | | 52 | SER | 91 | THR |
| | | 106 | TYR | | | | | 53 | SER | 92 | ASN |
| | | | | | | | | 54 | LEU | | |
| | | | | | | | | 55 | GLN | | |
| | | | | | | | | 56 | SER | | |
| | | | | | | | | 57 | GLY | | |
| | | | | | | | | 65 | SER | | |
| | | | | | | | | 66 | GLY | | |
| | | | | | | | | 67 | SER | | |
| | | | | | | | | 68 | GLY | | |
| | | | | | | | | 71 | PHE | | |
| | | | | | | | | 90 | GLN | | |
| | | | | | | | | 91 | THR | | |
| | | | | | | | | 92 | ASN | | |
| | | | | | | | | 93 | SER | | |
| | | | | | | | | 94 | PHE | | |

TABLE 19

GIPR ECD epitope residues in GIPR-Fab Gipg013 complex (PDB 4HJ0) defined by solvent exposure differences and distance cutoff method

| GIPR residues within 5 A of Gipg013 | | GIPR residues within 8 A of Gipg013 | | GIPR residues identified by ASA differences | |
|---|---|---|---|---|---|
| number | residue | number | residue | number | residue |
| 32 | ALA | 31 | THR | 32 | ALA |
| 33 | GLY | 32 | ALA | 33 | GLY |
| 35 | LEU | 33 | GLY | 35 | LEU |
| 36 | TYR | 34 | GLU | 36 | TYR |
| 37 | GLN | 35 | LEU | 37 | GLN |
| 39 | TRP | 36 | TYR | 39 | TRP |
| 40 | GLU | 37 | GLN | 40 | GLU |
| 43 | ARG | 38 | ARG | 43 | ARG |
| 47 | GLN | 39 | TRP | 44 | ARG |
| 65 | PHE | 40 | GLU | 47 | GLN |
| 66 | ASP | 41 | ARG | 65 | PHE |
| 67 | MET | 43 | ARG | 66 | ASP |
| 68 | TYR | 44 | ARG | 67 | MET |
| 87 | TYR | 47 | GLN | 68 | TYR |
| 88 | LEU | 64 | SER | 87 | TYR |
| 89 | PRO | 65 | PHE | 88 | LEU |
| 90 | TRP | 66 | ASP | 89 | PRO |
| 113 | ARG | 67 | MET | 90 | TRP |
| 115 | HIS | 68 | TYR | 111 | LEU |
| 119 | GLU | 69 | VAL | 113 | ARG |
| 121 | PRO | 71 | TRP | 115 | HIS |
| 122 | GLU | 85 | PRO | 119 | GLU |
| | | 87 | TYR | 121 | PRO |
| | | 88 | LEU | 122 | GLU |
| | | 89 | PRO | | |
| | | 90 | TRP | | |
| | | 91 | HIS | | |
| | | 99 | VAL | | |
| | | 101 | ARG | | |
| | | 108 | GLN | | |
| | | 111 | LEU | | |
| | | 112 | TRP | | |
| | | 113 | ARG | | |
| | | 114 | ASP | | |
| | | 115 | HIS | | |
| | | 116 | THR | | |
| | | 117 | GLN | | |
| | | 118 | CYS | | |
| | | 119 | GLU | | |
| | | 120 | ASN | | |
| | | 121 | PRO | | |
| | | 122 | GLU | | |

LENGTHY TABLES

The patent contains a lengthy table section. A copy of the table is available in electronic form from the USPTO web site (http://seqdata.uspto.gov/?pageRequest=docDetail&DocID=US10294303B2). An electronic copy of the table will also be available from the USPTO upon request and payment of the fee set forth in 37 CFR 1.19(b)(3).

SEQUENCE LISTING (3225 sequences)

SEQ ID NO: 1 - protein, 111 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLNGPVFGGGTKLTVLG

SEQ ID NO: 2 - protein, 108 aa, Artificial Sequence
  Description of Artificial Sequence: Synthetic polypeptide
DIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGPGTKVDIKR

SEQ ID NO: 3 - protein, 108 aa, Artificial Sequence; identical to SEQ ID NO: 2
  Description of Artificial Sequence: Synthetic polypeptide

SEQ ID NO: 4 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFSFTISSLQPEDIATYYCQQYDILLTFGGGTKVEIKR

SEQ ID NO: 5 - protein, 114 aa, Artificial Sequence
  Description of Artificial Sequence: Synthetic polypeptide
DIVMTQSPDSLAVSLGERATINCKSSQSVLSSSNNKNYIAWYQQQPGHPPKLLIYWASTRESGVPDRFSGSGSGTDFTLTISSLQAEDVAVFYCQQYYSTPWTFGQGTKVEIKR

SEQ ID NO: 6 - protein, 114 aa, Artificial Sequence
  Description of Artificial Sequence: Synthetic polypeptide
DIVMTQSPDSLAVSLGERATINCKSSQSVLSSSNNKNYIAWYQQKPGHPPKLLIYWASTRESGVPDRFSGSGSGTDFTLTISSLQAEDVAVFYCQQYYSTPWTFGQGTKVEIKR

SEQ ID NO: 7 - protein, 114 aa, Artificial Sequence
  Description of Artificial Sequence: Synthetic polypeptide
DIVMTQSPDSLSVSLGERATINCKSSQSVLSSSNNKNYLAWYQQKPGQPPNLLIYWTSTRDSGVPDRFSGSGSGTDFTLTINSLQAEDVAVYYCQQYYRTPWTFGQGTKVEIKR

SEQ ID NO: 8 - protein, 114 aa, Artificial Sequence; identical to SEQ ID NO: 7
  Description of Artificial Sequence: Synthetic polypeptide

SEQ ID NO: 9 - protein, 109 aa, Artificial Sequence
  Description of Artificial Sequence: Synthetic polypeptide
EIVLTQSPGTLSLSPGERATLSCRASQSISYSYLAWYQQKPGQAPRLLIYGASSRATGIPDRFSGSGSGTDFTLTISRQEPDDFAVYYCQQYGSSPLTFGGGTKVEIKR

SEQ ID NO: 10 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKR

SEQ ID NO: 11 - protein, 108 aa, Artificial Sequence
  Description of Artificial Sequence: Synthetic polypeptide
DIQMTQSPSSLSASVGDRVTITCRASQGIRNELGWYQQKPGKAPKRLIYGASSLQSGVPSRFSGSGSGTEFTLTISSLQPEDFVTYYCLQHNSYPFTFGPGTKVDVKR

SEQ ID NO: 12 - protein, 107 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTFTISSLQPEDIATYYCQQYDDLFTFGPGTKVDIKR

SEQ ID NO: 13 - protein, 108 aa, Artificial Sequence
  Description of Artificial Sequence: Synthetic polypeptide
DIQMTQSPSSVSASVGDRVTITCRASQGLIIWLAWYQQKPGKAPKLLIYAASSLQSGVPSRFSGSGSGTDFTLTISSLQPEDFATYYCQQTNSFPPTFGQGTKVEIKR

SEQ ID NO: 14 - protein, 108 aa, Artificial Sequence; identical to SEQ ID NO: 13
  Description of Artificial Sequence: Synthetic polypeptide

SEQ ID NO: 15 - protein, 108 aa, Artificial Sequence
  Description of Artificial Sequence: Synthetic polypeptide
DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGQGTKVDVKR

SEQ ID NO: 16 - protein, 108 aa, Artificial Sequence; identical to SEQ ID NO: 15
  Description of Artificial Sequence: Synthetic polypeptide

SEQ ID NO: 17 - protein, 108 aa, Artificial Sequence; identical to SEQ ID NO: 15
  Description of Artificial Sequence: Synthetic polypeptide

SEQ ID NO: 18 - protein, 108 aa, Artificial Sequence
  Description of Artificial Sequence: Synthetic polypeptide
DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGPGTKVDVKR

SEQ ID NO: 19 - protein, 108 aa, Artificial Sequence
  Description of Artificial Sequence: Synthetic polypeptide
DIQMTQSPSSLSASVGDRVTITCRASQGIRNELGWYQQKPGKAPKRLIYGASSLQSGVPSRFSGSGSGTEFTLTISSLQPEDFVTYYCLQHNSYPFTFGQGTKVDVKR

SEQ ID NO: 20 - protein, 108 aa, Artificial Sequence; identical to SEQ ID NO: 15
  Description of Artificial Sequence: Synthetic polypeptide

SEQ ID NO: 21 - protein, 108 aa, Artificial Sequence
  Description of Artificial Sequence: Synthetic polypeptide
DIQMTQSPSSLSASIGDRVTITCRASQDIRDYLGWYQQKPGKAPKLLIYGASSLQSGVPSRFSGSGSGTEFTLTISSLQPEDFATYYCLQHNNYPFTFGQGTKVDIKR

SEQ ID NO: 22 - protein, 108 aa, Artificial Sequence
  Description of Artificial Sequence: Synthetic polypeptide
DIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGQGTKVDIKR

SEQ ID NO: 23 - protein, 108 aa, Artificial Sequence
  Description of Artificial Sequence: Synthetic polypeptide
DIQMTQSPSSLSASIGDRVTITCRASQDIRDYLGWYQQKPGKAPKLLIYGASSLQSGVPSRFSGSGSGTEFTLTISSLQPEDFATYYCLQHNNYPFTFGPGTKVDIKR

SEQ ID NO: 24 - protein, 108 aa, Artificial Sequence; identical to SEQ ID NO: 21
  Description of Artificial Sequence: Synthetic polypeptide

SEQ ID NO: 25 - protein, 108 aa, Artificial Sequence; identical to SEQ ID NO: 21
  Description of Artificial Sequence: Synthetic polypeptide

SEQ ID NO: 26 - protein, 108 aa, Artificial Sequence; identical to SEQ ID NO: 21
  Description of Artificial Sequence: Synthetic polypeptide

SEQ ID NO: 27 - protein, 108 aa, Artificial Sequence; identical to SEQ ID NO: 21
  Description of Artificial Sequence: Synthetic polypeptide

SEQ ID NO: 28 - protein, 108 aa, Artificial Sequence
  Description of Artificial Sequence: Synthetic polypeptide
DIQMTQSPSSLSASIGDRVTITCRASQDLRNYLGWYHQKPGKAPKRLIYGASSLQSGVPSRFSGSGSGTEFTLTISSLQPEDFATYYCLQHNNYPFTFGPGTKVDIKR

SEQ ID NO: 29 - protein, 108 aa, Artificial Sequence
  Description of Artificial Sequence: Synthetic polypeptide
DIQMTQSPSSLSASIGDRVTITCRASQDLRNYLGWYQQKPGKAPKLLIYGASSLQSGVPSRFSGSGSGTEFTLTISSLQPEDFATYYCLQHNNYPFTFGPGTKVDIKR

SEQ ID NO: 30 - protein, 108 aa, Artificial Sequence; identical to SEQ ID NO: 29
  Description of Artificial Sequence: Synthetic polypeptide

SEQ ID NO: 31 - protein, 108 aa, Artificial Sequence
  Description of Artificial Sequence: Synthetic polypeptide
DIQMTQSPSSLSASIGDRVTITCRASQDLRNYLGWYHQKPGKAPKLLIYGASSLQSGVPSRFSGSGSGTEFTLTISSLQPEDFATYYCLQHNNYPFTFGPGTKVDIKR

SEQ ID NO: 32 - protein, 108 aa, Artificial Sequence
  Description of Artificial Sequence: Synthetic polypeptide
DIQMTQSPSSLSASIGDRVTITCRASQDLRNYLGWYQQKPGKAPKRLIYGASSLQSGVPSRFSGSGSGTEFTLTISSLQPEDFATYYCLQHNNYPFTFGPGTKVDIKR

SEQ ID NO: 33 - protein, 108 aa, Artificial Sequence; identical to SEQ ID NO: 32
  Description of Artificial Sequence: Synthetic polypeptide

SEQ ID NO: 34 - protein, 108 aa, Artificial Sequence; identical to SEQ ID NO: 31
  Description of Artificial Sequence: Synthetic polypeptide

SEQ ID NO: 35 - protein, 108 aa, Artificial Sequence; identical to SEQ ID NO: 28
  Description of Artificial Sequence: Synthetic polypeptide

SEQ ID NO: 36 - protein, 108 aa, Artificial Sequence; identical to SEQ ID NO: 29
  Description of Artificial Sequence: Synthetic polypeptide

SEQ ID NO: 37 - protein, 108 aa, Artificial Sequence; identical to SEQ ID NO: 29
  Description of Artificial Sequence: Synthetic polypeptide

SEQ ID NO: 38 - protein, 108 aa, Artificial Sequence
  Description of Artificial Sequence: Synthetic polypeptide
DIQMTQSPSSLSASIGDRVTITCRASQDLRNYLGWYQQKPGKAPKLLIYGASSLQSGVPSRFSGSGSGTEFTLTISSLQPEDFATYYCLQHNNYPFTFGQGTKVDIKR

SEQ ID NO: 39 - protein, 108 aa, Artificial Sequence; identical to SEQ ID NO: 29
  Description of Artificial Sequence: Synthetic polypeptide

SEQ ID NO: 40 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFSLTISSLQPEDFATYYCQQYDILLTFGGGTKVEIKR

SEQ ID NO: 41 - protein, 107 aa, Artificial Sequence; identical to SEQ ID NO: 40
  Description of Artificial Sequence: Synthetic polypeptide

SEQ ID NO: 42 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFSLTISSLQPEDIATYYCQQYDILLTFGGGTKVEIKR

SEQ ID NO: 43 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFSFTISSLQPEDFATYYCQQYDILLTFGGGTKVEIKR

SEQ ID NO: 44 - protein, 107 aa, Artificial Sequence; identical to SEQ ID NO: 42
  Description of Artificial Sequence: Synthetic polypeptide

SEQ ID NO: 45 - protein, 107 aa, Artificial Sequence; identical to SEQ ID NO: 43
  Description of Artificial Sequence: Synthetic polypeptide

SEQ ID NO: 46 - protein, 107 aa, Artificial Sequence; identical to SEQ ID NO: 4
  Description of Artificial Sequence: Synthetic polypeptide

SEQ ID NO: 47 - protein, 107 aa, Artificial Sequence; identical to SEQ ID NO: 40
  Description of Artificial Sequence: Synthetic polypeptide

SEQ ID NO: 48 - protein, 107 aa, Artificial Sequence; identical to SEQ ID NO: 40
  Description of Artificial Sequence: Synthetic polypeptide

SEQ ID NO: 49 - protein, 108 aa, Artificial Sequence; identical to SEQ ID NO: 2
  Description of Artificial Sequence: Synthetic polypeptide

SEQ ID NO: 50 - protein, 108 aa, Artificial Sequence; identical to SEQ ID NO: 2
  Description of Artificial Sequence: Synthetic polypeptide

SEQ ID NO: 51 - protein, 108 aa, Artificial Sequence; identical to SEQ ID NO: 21
  Description of Artificial Sequence: Synthetic polypeptide

SEQ ID NO: 52 - protein, 108 aa, Artificial Sequence; identical to SEQ ID NO: 21
  Description of Artificial Sequence: Synthetic polypeptide

SEQ ID NO: 53 - protein, 108 aa, Artificial Sequence; identical to SEQ ID NO: 23
  Description of Artificial Sequence: Synthetic polypeptide

SEQ ID NO: 54 - protein, 108 aa, Artificial Sequence; identical to SEQ ID NO: 23
  Description of Artificial Sequence: Synthetic polypeptide

SEQ ID NO: 55 - protein, 108 aa, Artificial Sequence; identical to SEQ ID NO: 23
  Description of Artificial Sequence: Synthetic polypeptide

SEQ ID NO: 56 - protein, 107 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTLTISSLQPEDFATYYCQQYDDLFTFGPGTKVDIKR

SEQ ID NO: 57 - protein, 107 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTLTISSLQPEDIATYYCQQYDDLFTFGPGTKVDIKR

SEQ ID NO: 58 - protein, 107 aa, Artificial Sequence; identical to SEQ ID NO: 56
  Description of Artificial Sequence: Synthetic polypeptide

SEQ ID NO: 59 - protein, 107 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTFTISSLQPEDFATYYCQQYDDLFTFGPGTKVDIKR

SEQ ID NO: 60 - protein, 107 aa, Artificial Sequence; identical to SEQ ID NO: 57
  Description of Artificial Sequence: Synthetic polypeptide

SEQ ID NO: 61 - protein, 107 aa, Artificial Sequence; identical to SEQ ID NO: 59
  Description of Artificial Sequence: Synthetic polypeptide

SEQ ID NO: 62 - protein, 107 aa, Artificial Sequence; identical to SEQ ID NO: 12
  Description of Artificial Sequence: Synthetic polypeptide

SEQ ID NO: 63 - protein, 107 aa, Artificial Sequence; identical to SEQ ID NO: 56
  Description of Artificial Sequence: Synthetic polypeptide

SEQ ID NO: 64 - protein, 107 aa, Artificial Sequence; identical to SEQ ID NO: 56
  Description of Artificial Sequence: Synthetic polypeptide

SEQ ID NO: 65 - protein, 107 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTLTISSLQPEDFATYYCQQYDDLFTFGQGTKVDIKR

SEQ ID NO: 66 - protein, 107 aa, Artificial Sequence; identical to SEQ ID NO: 65
  Description of Artificial Sequence: Synthetic polypeptide

SEQ ID NO: 67 - protein, 108 aa, Artificial Sequence
  Description of Artificial Sequence: Synthetic polypeptide
EIVLTQSPGTLSLSPGERATLSCRASQIFTSTYLAWYQQKPGQAPRLLIYGASSRATGIPDRFSGSGSGTDFTLTISRLEPEDFAVYYCQQYGSSPRFGQGTRLEIKR

SEQ ID NO: 68 - protein, 108 aa, Artificial Sequence; identical to SEQ ID NO: 67
  Description of Artificial Sequence: Synthetic polypeptide

SEQ ID NO: 69 - protein, 108 aa, Artificial Sequence; identical to SEQ ID NO: 67
  Description of Artificial Sequence: Synthetic polypeptide

SEQ ID NO: 70 - protein, 108 aa, Artificial Sequence; identical to SEQ ID NO: 67
  Description of Artificial Sequence: Synthetic polypeptide

SEQ ID NO: 71 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKR

SEQ ID NO: 72 - protein, 108 aa, Artificial Sequence; identical to SEQ ID NO: 71
  Description of Artificial Sequence: Synthetic polypeptide

SEQ ID NO: 73 - protein, 108 aa, Artificial Sequence; identical to SEQ ID NO: 71
  Description of Artificial Sequence: Synthetic polypeptide

SEQ ID NO: 74 - protein, 108 aa, Artificial Sequence; identical to SEQ ID NO: 10
  Description of Artificial Sequence: Synthetic polypeptide

SEQ ID NO: 75 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARFSGSGSGTEFTLTISSLEPEDFAVYYCQQYNNFPLTFGGGTKVEIKR

SEQ ID NO: 76 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARFSGSGSGTEFTLTISSLEPEDFAVYYCQQYNNYPLTFGGGTKVEIKR

SEQ ID NO: 77 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARFSGSGSGTEFTLTISSLEPEDFAVYYCQQYNNWPLTFGGGTKVEIKR

SEQ ID NO: 78 - protein, 108 aa, Artificial Sequence; identical to SEQ ID NO: 77
  Description of Artificial Sequence: Synthetic polypeptide

SEQ ID NO: 79 - protein, 109 aa, Artificial Sequence
  Description of Artificial Sequence: Synthetic polypeptide
EIVLTQSPGTLSLSPGERATLSCRASQSISYSYLAWYQQKPGQAPRLLIYGASSRATGIPDRFSGSGSGTDFTLTISRLEPDDFAVYYCQQYGSSPLTFGGGTKVEIKR

SEQ ID NO: 80 - protein, 109 aa, Artificial Sequence; identical to SEQ ID NO: 9
  Description of Artificial Sequence: Synthetic polypeptide

SEQ ID NO: 81 - protein, 109 aa, Artificial Sequence; identical to SEQ ID NO: 79
  Description of Artificial Sequence: Synthetic polypeptide

SEQ ID NO: 82 - protein, 109 aa, Artificial Sequence; identical to SEQ ID NO: 79
  Description of Artificial Sequence: Synthetic polypeptide

SEQ ID NO: 83 - protein, 109 aa, Artificial Sequence; identical to SEQ ID NO: 79
  Description of Artificial Sequence: Synthetic polypeptide

SEQ ID NO: 84 - protein, 109 aa, Artificial Sequence; identical to SEQ ID NO: 9
  Description of Artificial Sequence: Synthetic polypeptide

SEQ ID NO: 85 - protein, 109 aa, Artificial Sequence; identical to SEQ ID NO: 9
  Description of Artificial Sequence: Synthetic polypeptide

SEQ ID NO: 86 - protein, 114 aa, Artificial Sequence; identical to SEQ ID NO: 5
  Description of Artificial Sequence: Synthetic polypeptide

SEQ ID NO: 87 - protein, 114 aa, Artificial Sequence; identical to SEQ ID NO: 5
  Description of Artificial Sequence: Synthetic polypeptide

SEQ ID NO: 88 - protein, 114 aa, Artificial Sequence; identical to SEQ ID NO: 5
  Description of Artificial Sequence: Synthetic polypeptide

SEQ ID NO: 89 - protein, 114 aa, Artificial Sequence; identical to SEQ ID NO: 5
  Description of Artificial Sequence: Synthetic polypeptide

SEQ ID NO: 90 - protein, 114 aa, Artificial Sequence; identical to SEQ ID NO: 5
  Description of Artificial Sequence: Synthetic polypeptide

SEQ ID NO: 91 - protein, 114 aa, Artificial Sequence; identical to SEQ ID NO: 5
  Description of Artificial Sequence: Synthetic polypeptide

SEQ ID NO: 92 - protein, 114 aa, Artificial Sequence; identical to SEQ ID NO: 5
  Description of Artificial Sequence: Synthetic polypeptide

SEQ ID NO: 93 - protein, 114 aa, Artificial Sequence; identical to SEQ ID NO: 5
  Description of Artificial Sequence: Synthetic polypeptide

SEQ ID NO: 94 - protein, 114 aa, Artificial Sequence; identical to SEQ ID NO: 5
  Description of Artificial Sequence: Synthetic polypeptide

SEQ ID NO: 95 - protein, 114 aa, Artificial Sequence
  Description of Artificial Sequence: Synthetic polypeptide
DIVMTQSPDSLAVSLGERATINCKSSQSVLSSSNNKNYIAWYQQKPGQPPKLLIYWASTRESGVPDRFSGSGSGTDFTLTISSLQAEDVAVFYCQQYYSTPWTFGQGTKVEIKR

SEQ ID NO: 96 - protein, 114 aa, Artificial Sequence; identical to SEQ ID NO: 95
  Description of Artificial Sequence: Synthetic polypeptide

SEQ ID NO: 97 - protein, 114 aa, Artificial Sequence
  Description of Artificial Sequence: Synthetic polypeptide
DIVMTQSPDSLSVSLGERATINCKSSQSVLSSSNNKNYLAWYQQKPGQPPNLLIYWTSTRESGVPDRFSGSGSGTDFTLTINSLQAEDVAVYYCQQYYRTPWTFGQGTKVEIKR

SEQ ID NO: 98 - protein, 114 aa, Artificial Sequence; identical to SEQ ID NO: 97
  Description of Artificial Sequence: Synthetic polypeptide

SEQ ID NO: 99 - protein, 114 aa, Artificial Sequence; identical to SEQ ID NO: 7
  Description of Artificial Sequence: Synthetic polypeptide

SEQ ID NO: 100 - protein, 114 aa, Artificial Sequence; identical to SEQ ID NO: 97
  Description of Artificial Sequence: Synthetic polypeptide

SEQ ID NO: 101 - protein, 114 aa, Artificial Sequence; identical to SEQ ID NO: 97
  Description of Artificial Sequence: Synthetic polypeptide

SEQ ID NO: 102 - protein, 114 aa, Artificial Sequence; identical to SEQ ID NO: 7
  Description of Artificial Sequence: Synthetic polypeptide

SEQ ID NO: 103 - protein, 114 aa, Artificial Sequence; identical to SEQ ID NO: 7
  Description of Artificial Sequence: Synthetic polypeptide

SEQ ID NO: 104 - protein, 114 aa, Artificial Sequence
  Description of Artificial Sequence: Synthetic polypeptide
DIVMTQSPDSLAVSLGERATINCKSSQSVLSSSNNKNYLAWYQQKPGQPPKLLIYWTSTRESGVPDRFSGSGSGTDFTLTINSLQAEDVAVYYCQQYYRTPWTFGQGTKVEIKR

SEQ ID NO: 105 - protein, 114 aa, Artificial Sequence; identical to SEQ ID NO: 97
  Description of Artificial Sequence: Synthetic polypeptide

SEQ ID NO: 106 - protein, 114 aa, Artificial Sequence; identical to SEQ ID NO: 6
  Description of Artificial Sequence: Synthetic polypeptide

SEQ ID NO: 107 - protein, 114 aa, Artificial Sequence; identical to SEQ ID NO: 6
  Description of Artificial Sequence: Synthetic polypeptide

SEQ ID NO: 108 - protein, 114 aa, Artificial Sequence; identical to SEQ ID NO: 6
  Description of Artificial Sequence: Synthetic polypeptide

SEQ ID NO: 109 - protein, 114 aa, Artificial Sequence; identical to SEQ ID NO: 95
  Description of Artificial Sequence: Synthetic polypeptide

SEQ ID NO: 110 - protein, 114 aa, Artificial Sequence; identical to SEQ ID NO: 95
  Description of Artificial Sequence: Synthetic polypeptide

SEQ ID NO: 111 - protein, 114 aa, Artificial Sequence; identical to SEQ ID NO: 7
  Description of Artificial Sequence: Synthetic polypeptide

SEQ ID NO: 112 - protein, 114 aa, Artificial Sequence; identical to SEQ ID NO: 7
  Description of Artificial Sequence: Synthetic polypeptide

SEQ ID NO: 113 - protein, 114 aa, Artificial Sequence; identical to SEQ ID NO: 7
  Description of Artificial Sequence: Synthetic polypeptide

SEQ ID NO: 114 - protein, 114 aa, Artificial Sequence; identical to SEQ ID NO: 7
  Description of Artificial Sequence: Synthetic polypeptide

SEQ ID NO: 115 - protein, 114 aa, Artificial Sequence; identical to SEQ ID NO: 7
  Description of Artificial Sequence: Synthetic polypeptide

SEQ ID NO: 116 - protein, 114 aa, Artificial Sequence; identical to SEQ ID NO: 7
  Description of Artificial Sequence: Synthetic polypeptide

SEQ ID NO: 117 - protein, 114 aa, Artificial Sequence; identical to SEQ ID NO: 7
  Description of Artificial Sequence: Synthetic polypeptide

SEQ ID NO: 118 - protein, 114 aa, Artificial Sequence; identical to SEQ ID NO: 97
  Description of Artificial Sequence: Synthetic polypeptide

SEQ ID NO: 119 - protein, 114 aa, Artificial Sequence; identical to SEQ ID NO: 97
  Description of Artificial Sequence: Synthetic polypeptide

SEQ ID NO: 120 - protein, 114 aa, Artificial Sequence; identical to SEQ ID NO: 97
  Description of Artificial Sequence: Synthetic polypeptide

SEQ ID NO: 121 - protein, 114 aa, Artificial Sequence; identical to SEQ ID NO: 97
  Description of Artificial Sequence: Synthetic polypeptide

SEQ ID NO: 122 - protein, 114 aa, Artificial Sequence
  Description of Artificial Sequence: Synthetic polypeptide
DIVMTQSPDSLAVSLGERATINCKSSQSVLSSSNNKNYLAWYQQKPGQPPKLLIYWTSTRDSGVPDRFSGSGSGTDFTLTINSLQAEDVAVYYCQQYYRTPWTFGQGTKVEIKR

SEQ ID NO: 123 - protein, 114 aa, Artificial Sequence; identical to SEQ ID NO: 104
  Description of Artificial Sequence: Synthetic polypeptide

SEQ ID NO: 124 - protein, 111 aa, Artificial Sequence
  Description of Artificial Sequence: Synthetic polypeptide
QSVLTQPPSASGTPGQRVTISCSGSSSNIGSQTVNWYQHLPGTAPKLLIYTNNQRPSGVPDRFSGSKSGTSASLAISGLQSEDEADYFCATFDESLSGPVFGGGTKLTVLG

SEQ ID NO: 125 - protein, 111 aa, Artificial Sequence
  Description of Artificial Sequence: Synthetic polypeptide
QSVLTQPPSASGTPGQRVTISCSGSSSNIGSQTVNWYQHLPGTAPKLLIYTNNQRPSGVPDRFSGSKSGTSASLAISGLQSEDEADYFCATFDESLQGPVFGGGTKLTVLG

SEQ ID NO: 126 - protein, 111 aa, Artificial Sequence
  Description of Artificial Sequence: Synthetic polypeptide
QSVLTQPPSASGTPGQRVTISCSGSSSNIGSNYVNWYQHLPGTAPKLLIYTNNQRPSGVPDRFSGSKSGTSASLAISGLQSEDEADYFCATFDESLSGPVFGGGTKLTVLG

SEQ ID NO: 127 - protein, 111 aa, Artificial Sequence
  Description of Artificial Sequence: Synthetic polypeptide
QSVLTQPPSASGTPGQRVTISCSGSSSNIGSNYVNWYQHLPGTAPKLLIYTNNQRPSGVPDRFSGSKSGTSASLAISGLQSEDEADYFCATFDESLQGPVFGGGTKLTVLG

SEQ ID NO: 128 - protein, 111 aa, Artificial Sequence
  Description of Artificial Sequence: Synthetic polypeptide
QSVLTQPPSASGTPGQRVTISCSGSSSNIGSQTVNWYQHLPGTAPKLLIYTNNQRPSGVPDRFSGSKSGTSASLAISGLQSEDEADYFCATFDDSLNGPVFGGGTKLTVLG

SEQ ID NO: 129 - protein, 111 aa, Artificial Sequence
  Description of Artificial Sequence: Synthetic polypeptide
QSVLTQPPSASGTPGQRVTISCSGSSSNIGSNYVNWYQHLPGTAPKLLIYTNNQRPSGVPDRFSGSKSGTSASLAISGLQSEDEADYFCATFDDSLNGPVFGGGTKLTVLG

SEQ ID NO: 130 - protein, 111 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDESLNGPVFGGGTKLTVLG

SEQ ID NO: 131 - protein, 111 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLQGPVFGGGTKLTVLG

SEQ ID NO: 132 - protein, 111 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLSGPVFGGGTKLTVLG

SEQ ID NO: 133 - protein, 111 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLNAPVFGGGTKLTVLG

SEQ ID NO: 134 - protein, 111 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDSSLNGPVFGGGTKLTVLG

SEQ ID NO: 135 - protein, 111 aa, Artificial Sequence
  Description of Artificial Sequence: Synthetic polypeptide
QSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLG

SEQ ID NO: 136 - protein, 111 aa, Artificial Sequence; identical to SEQ ID NO: 135
  Description of Artificial Sequence: Synthetic polypeptide

SEQ ID NO: 137 - protein, 111 aa, Artificial Sequence; identical to SEQ ID NO: 124
  Description of Artificial Sequence: Synthetic polypeptide

SEQ ID NO: 138 - protein, 108 aa, Artificial Sequence
  Description of Artificial Sequence: Synthetic polypeptide
DIQMTQSPSSLSASIGDRVTITCRASQDLRNYLGWYQQKPGKAPKRLIYGASSLQSGVPSRFSGSGSGTEFTLTISSLQPEDFATYYCLQHNNYPFTFGQGTKVDIKR

SEQ ID NO: 139 - protein, 108 aa, Artificial Sequence; identical to SEQ ID NO: 22
  Description of Artificial Sequence: Synthetic polypeptide

SEQ ID NO: 140 - protein, 111 aa, Artificial Sequence
  Description of Artificial Sequence: Synthetic polypeptide
QSVLTQPPSASGTPGQRVTISCSGSSSNIGSNTVNWYQQLPGTAPKLLIYTNNQRPSGVPDRFSGSKSGTSASLAISGLQSEDEADYFCATFDSSLSGPVFGGGTKLTVLG

SEQ ID NO: 141 - protein, 108 aa, Artificial Sequence
  Description of Artificial Sequence: Synthetic polypeptide
DIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITR

SEQ ID NO: 142 - protein, 111 aa, Artificial Sequence
  Description of Artificial Sequence: Synthetic polypeptide
QSVLTQPPSVSAAPGQKVTISCSGSSSNIGNNYVSWYEQFPGTAPKLLIYDNNKRPSGIPDRFSGSKSGTSATLGITGLQTGDEADYYCGTWDSSLSAVVFGGGTKLTVLG

SEQ ID NO: 143 - protein, 108 aa, Artificial Sequence
  Description of Artificial Sequence: Synthetic polypeptide
DIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEIKR

SEQ ID NO: 144 - protein, 108 aa, Artificial Sequence; identical to SEQ ID NO: 143
  Description of Artificial Sequence: Synthetic polypeptide

SEQ ID NO: 145 - protein, 108 aa, Artificial Sequence; identical to SEQ ID NO: 141
  Description of Artificial Sequence: Synthetic polypeptide

SEQ ID NO: 146 - protein, 108 aa, Artificial Sequence
  Description of Artificial Sequence: Synthetic polypeptide
DIQLTQSPSSLSASVGDRVTITCRASQTISRFLNWYQQKPGKAPKLLIYVASSLQSGVPSRFSGSGSGTDFTLTISSLQPEDFATYYCQQSYSTLISFGQGTKLEIKR

SEQ ID NO: 147 - protein, 108 aa, Artificial Sequence; identical to SEQ ID NO: 143
  Description of Artificial Sequence: Synthetic polypeptide

SEQ ID NO: 148 - protein, 108 aa, Artificial Sequence; identical to SEQ ID NO: 143
  Description of Artificial Sequence: Synthetic polypeptide

SEQ ID NO: 149 - protein, 111 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVLG

SEQ ID NO: 150 - protein, 111 aa, Artificial Sequence; identical to SEQ ID NO: 149
  Description of Artificial Sequence: Synthetic polypeptide

SEQ ID NO: 151 - protein, 111 aa, Artificial Sequence; identical to SEQ ID NO: 142
  Description of Artificial Sequence: Synthetic polypeptide

SEQ ID NO: 152 - protein, 111 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLAITGLQTGDEADYYCGTFESSLSAVVFGGGTKLTVLG

SEQ ID NO: 153 - protein, 111 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSSLSAVVFGGGTKLTVLG

SEQ ID NO: 154 - protein, 111 aa, Artificial Sequence; identical to SEQ ID NO: 153
  Description of Artificial Sequence: Synthetic polypeptide

SEQ ID NO: 155 - protein, 111 aa, Artificial Sequence; identical to SEQ ID NO: 149
  Description of Artificial Sequence: Synthetic polypeptide

SEQ ID NO: 156 - protein, 111 aa, Artificial Sequence; identical to SEQ ID NO: 152
  Description of Artificial Sequence: Synthetic polypeptide

SEQ ID NO: 157 - protein, 108 aa, Artificial Sequence
  Description of Artificial Sequence: Synthetic polypeptide
DIQLTQSPSSLSASVGDRVTITCRASQTISRFLNWYQQKPGKAPKLLIYVASSLQSGVPSRFSGSGSGTDFTLTISSLQPEDFATYYCQQSYSTLLSFGQGTKLEIKR

SEQ ID NO: 158 - protein, 128 aa, Artificial Sequence
  Description of Artificial Sequence: Synthetic polypeptide
QMQVVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGDYVWGTYRPHYYYGMDVWGQGTTVTVSS

SEQ ID NO: 159 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDGSNENYADSVKGRFTISRDNSKNTLYLHMNSLRVADTAVYYCARDGTIFGVVLGDYWGQGTLVTVSS

SEQ ID NO: 160 - protein, 121 aa, Artificial Sequence
  Description of Artificial Sequence: Synthetic polypeptide
QVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSS

SEQ ID NO: 161 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISSDNSKNTLYLQMNSLRAEDTAVYYCARDRTIFGVVLDYWGQGTLVTVSS

SEQ ID NO: 162 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWINPDSGGTDYSQRFQGRFTMTRDTSISTAYMELNRLRSDDTAVYYCAREATIFGMVIVPFDYWGQGTLVTVSS

SEQ ID NO: 163 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWINPDSGGTDYSQRFQGRFTMTRDTSISTAYMELSRLRSDDTAVYYCAREATIFGMVIVPFDYWGQGTLVTVSS

SEQ ID NO: 164 - protein, 123 aa, Artificial Sequence
  Description of Artificial Sequence: Synthetic polypeptide
QVPLVQSGAEVKKPGASVKVSCKASGYTFTGYYIHWVRQAPGQGLVWMGWISPNSGDTSYAQKFQDRVTMTRDTSISTAYMELSRLRSDDTAVYFCTREATIFGMLIVPFDYWGQGTLVTVSS

SEQ ID NO: 165 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWISPNNGDTNYAQKFQDRVTMTRDTSISTAYMELSRLRSDDTAVYYCTREATIFGMLIVPFDYWGQGTLVTVSS

SEQ ID NO: 166 - protein, 126 aa, Artificial Sequence
  Description of Artificial Sequence: Synthetic polypeptide
QVQLQESGPGLVKPSQTLSLTCTVSGDSISSGGYYWSWIRQHPGKGLEWIGYIYYSGSTYYNPSLKSRVTISVDTSKNQFSLKLSSVTAADTAVYYCARDRITIFGVVMGGGMDVWGQGTTVTVSS

SEQ ID NO: 167 - protein, 120 aa, Artificial Sequence
  Description of Artificial Sequence: Synthetic polypeptide
QVQLVESGGGVVQPGRSLRLSCAASGFTFSNYGMHWVRQAPGEGLEWVAAIWFDGSDKYYADSVKGRFTISRDNSKNTLYLQMNSLRAEDTAVYYCARDQAIFGVVPDYWGQGTLVTVSS

SEQ ID NO: 168 - protein, 121 aa, Artificial Sequence; identical to SEQ ID NO: 160
  Description of Artificial Sequence: Synthetic polypeptide

SEQ ID NO: 169 - protein, 120 aa, Artificial Sequence
  Description of Artificial Sequence: Synthetic polypeptide
QVQLVESGGGVVQPGRSLRLSCAASGFSFSSYGMHWVRQPPGKGLEWVAAIWYDGNNKYYADSVKGRFTISRDSSKNTLYLQMNSLRAEDTAVYYCARDRTIFGVVLEYLGQGTLVTVSS

SEQ ID NO: 170 - protein, 117 aa, Artificial Sequence
  Description of Artificial Sequence: Synthetic polypeptide
QVQLQESGPGLVKPSETLSLTCTVSQGSISSYYWSWIRQPAGKGLEWIGRIYTSGSTNYNPSLKSRVTMSIDTSKNQFSLKLNSVTAADTAVYYCARDVAVAGFDYWGQGTLVTVSS

SEQ ID NO: 171 - protein, 117 aa, Artificial Sequence
  Description of Artificial Sequence: Synthetic polypeptide
QVQLQESGPGLVKPSETLSLTCTVSGGSISSYYWSWIRQPAGKGLEWIGRIYTSGSTNYNPSLKSRVTMSIDTSKNQFSLKLNSVTAADTAVYYCARDVAVAGFDYWGQGTLVTVSS

SEQ ID NO: 172 - protein, 121 aa, Artificial Sequence
  Description of Artificial Sequence: Synthetic polypeptide
QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDGTIFGVLLGDYWGQGTLVTVSS

SEQ ID NO: 173 - protein, 121 aa, Artificial Sequence
  Description of Artificial Sequence: Synthetic polypeptide
QVQLVESGGGVVQPGRSLRLSCAASGFTFSYFGMHWVRQAPGKGLEWVAVIWYDASNKYYADSVKGRFTISRDNSKNTLYLQMNSLRAEDTAVYYCARDGTIFGVLLGDYWGQGTLVTVSS

SEQ ID NO: 174 - protein, 121 aa, Artificial Sequence
  Description of Artificial Sequence: Synthetic polypeptide
QVQLVESGGGVVQPGRSLRLSCAASGFTFSYFGMHWVRQAPGKGLEWVAVIWYDGSNKYYADAVKGRFTISRDNSKNTLYLQMNSLRAEDTAVYYCARDGTIFGVLLGDYWGQGTLVTVSS

SEQ ID NO: 175 - protein, 121 aa, Artificial Sequence; identical to SEQ ID NO: 172
  Description of Artificial Sequence: Synthetic polypeptide

SEQ ID NO: 176 - protein, 121 aa, Artificial Sequence; identical to SEQ ID NO: 172
  Description of Artificial Sequence: Synthetic polypeptide

SEQ ID NO: 177 - protein, 121 aa, Artificial Sequence
  Description of Artificial Sequence: Synthetic polypeptide
QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDRTIFGVLLGDYWGQGTLVTVSS

SEQ ID NO: 178 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRVADTAVYYCARDGTIFGVVLGDYWGQGTLVTVSS

SEQ ID NO: 179 - protein, 121 aa, Artificial Sequence; identical to SEQ ID NO: 178
  Description of Artificial Sequence: Synthetic polypeptide

SEQ ID NO: 180 - protein, 121 aa, Artificial Sequence; identical to SEQ ID NO: 178
  Description of Artificial Sequence: Synthetic polypeptide

SEQ ID NO: 181 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADSVKGRFTISRDNSKNTLYLHMNSLRVADTAVYYCARDGTIFGVVLGDYWGQGTLVTVSS

SEQ ID NO: 182 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDGSNENYADAVKGRFTISRDNSKNTLYLHMNSLRVADTAVYYCARDGTIFGVVLGDYWGQGTLVTVSS

SEQ ID NO: 183 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRVEDTAVYYCARDRTIFGVVLGDYWGQGTLVTVSS

SEQ ID NO: 184 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRVEDTAVYYCARDGTIFGVVLGDYWGQGTLVTVSS

SEQ ID NO: 185 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDGSNENYADSVKGRFTISRDNSKNTLYLHMNSLRAADTAVYYCARDGTIFGVVLGDYWGQGTLVTVSS

SEQ ID NO: 186 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRAADTAVYYCARDGTIFGVVLGDYWGQGTLVTVSS

SEQ ID NO: 187 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLHMNSLRAADTAVYYCARDGTIFGVVLGDYWGQGTLVTVSS

SEQ ID NO: 188 - protein, 121 aa, Artificial Sequence; identical to SEQ ID NO: 186
  Description of Artificial Sequence: Synthetic polypeptide

SEQ ID NO: 189 - protein, 121 aa, Artificial Sequence; identical to SEQ ID NO: 186
  Description of Artificial Sequence: Synthetic polypeptide

SEQ ID NO: 190 - protein, 121 aa, Artificial Sequence; identical to SEQ ID NO: 187
  Description of Artificial Sequence: Synthetic polypeptide

SEQ ID NO: 191 - protein, 121 aa, Artificial Sequence; identical to SEQ ID NO: 187
  Description of Artificial Sequence: Synthetic polypeptide

SEQ ID NO: 192 - protein, 121 aa, Artificial Sequence; identical to SEQ ID NO: 186
  Description of Artificial Sequence: Synthetic polypeptide

SEQ ID NO: 193 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDGSNENYADAVKGRFTISRDNSKNTLYLQMNSLRAADTAVYYCARDGTIFGVVLGDYWGQGTLVTVSS

SEQ ID NO: 194 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADSVKGRFTISRDNSKNTLYLQMNSLRAADTAVYYCARDGTIFGVVLGDYWGQGTLVTVSS

SEQ ID NO: 195 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRAEDTAVYYCARDRTIFGVVLGDYWGQGTLVTVSS

SEQ ID NO: 196 - protein, 121 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRAEDTAVYYCARDGTIFGVVLGDYWGQGTLVTVSS

SEQ ID NO: 197 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDASNKYYADAVKGRFTISRDNSKNTLYLQMNSLRAEDTAVYYCARDRTIFGVVLDYWGQGTLVTVSS

SEQ ID NO: 198 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDASNKYYADAVKGRFTISSDNSKNTLYLQMNSLRAEDTAVYYCARDRTIFGVVLDYWGQGTLVTVSS

SEQ ID NO: 199 - protein, 120 aa, Artificial Sequence; identical to SEQ ID NO: 197
  Description of Artificial Sequence: Synthetic polypeptide

SEQ ID NO: 200 - protein, 120 aa, Artificial Sequence; identical to SEQ ID NO: 197
  Description of Artificial Sequence: Synthetic polypeptide

SEQ ID NO: 201 - protein, 120 aa, Artificial Sequence; identical to SEQ ID NO: 198
  Description of Artificial Sequence: Synthetic polypeptide

SEQ ID NO: 202 - protein, 120 aa, Artificial Sequence; identical to SEQ ID NO: 198
  Description of Artificial Sequence: Synthetic polypeptide

SEQ ID NO: 203 - protein, 120 aa, Artificial Sequence; identical to SEQ ID NO: 197
  Description of Artificial Sequence: Synthetic polypeptide

SEQ ID NO: 204 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDASNKYYADSVKGRFTISRDNSKNTLYLQMNSLRAEDTAVYYCARDRTIFGVVLDYWGQGTLVTVSS

SEQ ID NO: 205 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADAVKGRFTISRDNSKNTLYLQMNSLRAEDTAVYYCARDRTIFGVVLDYWGQGTLVTVSS

SEQ ID NO: 206 - protein, 121 aa, Artificial Sequence; identical to SEQ ID NO: 172
  Description of Artificial Sequence: Synthetic polypeptide

SEQ ID NO: 207 - protein, 121 aa, Artificial Sequence; identical to SEQ ID NO: 177
  Description of Artificial Sequence: Synthetic polypeptide

SEQ ID NO: 208 - protein, 121 aa, Artificial Sequence; identical to SEQ ID NO: 172
  Description of Artificial Sequence: Synthetic polypeptide

SEQ ID NO: 209 - protein, 121 aa, Artificial Sequence; identical to SEQ ID NO: 177
  Description of Artificial Sequence: Synthetic polypeptide

SEQ ID NO: 210 - protein, 121 aa, Artificial Sequence; identical to SEQ ID NO: 160
  Description of Artificial Sequence: Synthetic polypeptide

SEQ ID NO: 211 - protein, 121 aa, Artificial Sequence; identical to SEQ ID NO: 173
  Description of Artificial Sequence: Synthetic polypeptide

SEQ ID NO: 212 - protein, 121 aa, Artificial Sequence; identical to SEQ ID NO: 174
  Description of Artificial Sequence: Synthetic polypeptide

SEQ ID NO: 213 - protein, 120 aa, Artificial Sequence
  Description of Artificial Sequence: Synthetic polypeptide
QVQLVESGGGVVQPGRSLRLSCAASGFSFSSYGMHWVRQPPGKGLEWVAAIWYDANNKYYADAVKGRFTISRDSSKNTLYLQMNSLRAEDTAVYYCARDRTIFGVVLEYWGQGTLVTVSS

SEQ ID NO: 214 - protein, 120 aa, Artificial Sequence; identical to SEQ ID NO: 213
  Description of Artificial Sequence: Synthetic polypeptide

SEQ ID NO: 215 - protein, 120 aa, Artificial Sequence
  Description of Artificial Sequence: Synthetic polypeptide
QVQLVESGGGVVQPGRSLRLSCAASGFSFSSYGMHWVRQPPGKGLEWVAAIWYDANNKYYADAVKGRFTISRDSSKNTLYLQMNSLRAEDTAVYYCARDRTIFGVVLEYLGQGTLVTVSS

SEQ ID NO: 216 - protein, 120 aa, Artificial Sequence; identical to SEQ ID NO: 213
  Description of Artificial Sequence: Synthetic polypeptide

SEQ ID NO: 217 - protein, 120 aa, Artificial Sequence; identical to SEQ ID NO: 215
  Description of Artificial Sequence: Synthetic polypeptide

SEQ ID NO: 218 - protein, 120 aa, Artificial Sequence; identical to SEQ ID NO: 215
  Description of Artificial Sequence: Synthetic polypeptide

SEQ ID NO: 219 - protein, 120 aa, Artificial Sequence; identical to SEQ ID NO: 213
  Description of Artificial Sequence: Synthetic polypeptide

SEQ ID NO: 220 - protein, 120 aa, Artificial Sequence
  Description of Artificial Sequence: Synthetic polypeptide
QVQLVESGGGVVQPGRSLRLSCAASGFSFSSYGMHWVRQPPGKGLEWVAAIWYDGNNKYYADAVKGRFTISRDSSKNTLYLQMNSLRAEDTAVYYCARDRTIFGVVLEYWGQGTLVTVSS

SEQ ID NO: 221 - protein, 120 aa, Artificial Sequence
  Description of Artificial Sequence: Synthetic polypeptide
QVQLVESGGGVVQPGRSLRLSCAASGFSFSSYGMHWVRQPPGKGLEWVAAIWYDANNKYYADSVKGRFTISRDSSKNTLYLQMNSLRAEDTAVYYCARDRTIFGVVLEYWGQGTLVTVSS

SEQ ID NO: 222 - protein, 120 aa, Artificial Sequence; identical to SEQ ID NO: 213
  Description of Artificial Sequence: Synthetic polypeptide

SEQ ID NO: 223 - protein, 120 aa, Artificial Sequence; identical to SEQ ID NO: 215
  Description of Artificial Sequence: Synthetic polypeptide

SEQ ID NO: 224 - protein, 120 aa, Artificial Sequence
  Description of Artificial Sequence: Synthetic polypeptide
QVQLVESGGGVVQPGRSLRLSCAASGFSFSSYGMHWVRQAPGKGLEWVAVIWYDASNKYYEDAVKGRFTISRDNSKNTLFLQVNSLRAEDTAVYYCARGITIFGHGFEYWGQGTLVTVSS

SEQ ID NO: 225 - protein, 120 aa, Artificial Sequence
  Description of Artificial Sequence: Synthetic polypeptide
QVQLVESGGGVVQPGRSLRLSCAASGFSFSSYGMHWVRQAPGKGLEWVAVIWYDGSNKYYEDSVKGRFTISRDNSKNTLFLQVNSLRAEDTAVYYCARGITIFGHGFEYWGQGTLVTVSS

SEQ ID NO: 226 - protein, 120 aa, Artificial Sequence
  Description of Artificial Sequence: Synthetic polypeptide
QVQLVESGGGVVQPGRSLRLSCAASGFSFSSYGMHWVRQAPGKGLEWVAVIWYDGSNKYYEDAVKGRFTISRDNSKNTLFLQVNSLRAEDTAVYYCARGITIFGHGFEYWGQGTLVTVSS

SEQ ID NO: 227 - protein, 120 aa, Artificial Sequence
  Description of Artificial Sequence: Synthetic polypeptide
QVQLVESGGGVVQPGRSLRLSCAASGFSFSSYGMHWVRQAPGKGLEWVAVIWYDASNKYYEDSVKGRFTISRDNSKNTLFLQVNSLRAEDTAVYYCARGITIFGHGFEYWGQGTLVTVSS

SEQ ID NO: 228 - protein, 120 aa, Artificial Sequence
  Description of Artificial Sequence: Synthetic polypeptide
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSS

SEQ ID NO: 229 - protein, 120 aa, Artificial Sequence
  Description of Artificial Sequence: Synthetic polypeptide
QVQLVESGGGVVQPGRSLRLSCAASGFTFSNYGMHWVRQAPGEGLEWVAAIWFDASDKYYADSVKGRFTISRDNSKNTLYLQMNSLRAEDTAVYYCARDQAIFGVVPDYWGQGTLVTVSS

SEQ ID NO: 230 - protein, 120 aa, Artificial Sequence
  Description of Artificial Sequence: Synthetic polypeptide
QVQLVESGGGVVQPGRSLRLSCAASGFTFSNYGMHWVRQAPGEGLEWVAAIWFDGSDKYYADAVKGRFTISRDNSKNTLYLQMNSLRAEDTAVYYCARDQAIFGVVPDYWGQGTLVTVSS

SEQ ID NO: 231 - protein, 120 aa, Artificial Sequence; identical to SEQ ID NO: 228
  Description of Artificial Sequence: Synthetic polypeptide

SEQ ID NO: 232 - protein, 120 aa, Artificial Sequence
  Description of Artificial Sequence: Synthetic polypeptide
QVQLVESGGGVVQPGRSLRLSCAASGFTFSNYGMHWVRQAPGKGLEWVAAIWFDASDKYYADAVKGRFTISRDNSKNTLYLQMNSLRAEDTAVYYCARDQAIFGVVPDYWGQGTLVTVSS

SEQ ID NO: 233 - protein, 120 aa, Artificial Sequence; identical to SEQ ID NO: 232
  Description of Artificial Sequence: Synthetic polypeptide

SEQ ID NO: 234 - protein, 120 aa, Artificial Sequence; identical to SEQ ID NO: 228
  Description of Artificial Sequence: Synthetic polypeptide

SEQ ID NO: 235 - protein, 120 aa, Artificial Sequence; identical to SEQ ID NO: 232
  Description of Artificial Sequence: Synthetic polypeptide

SEQ ID NO: 236 - protein, 126 aa, Artificial Sequence
  Description of Artificial Sequence: Synthetic polypeptide
QVQLQESGPGLVKPSETLSLTCTVSGDSISSGGYYWSWIRQPPGKGLEWIGYIYYSGSTYYNPSLKSRVTISVDTSKNQFSLKLSSVTAADTAVYYCARDRITIFGVVMGGGMDVWGQGTTVTVSS

SEQ ID NO: 237 - protein, 126 aa, Artificial Sequence; identical to SEQ ID NO: 236
  Description of Artificial Sequence: Synthetic polypeptide

SEQ ID NO: 238 - protein, 126 aa, Artificial Sequence
  Description of Artificial Sequence: Synthetic polypeptide
QVQLQESGPGLVKPSQTLSLTCTVSGDSISSGGYYWSWIRQPPGKGLEWIGYIYYSGSTYYNPSLKSRVTISVDTSKNQFSLKLSSVTAADTAVYYCARDRITIFGVVMGGGMDVWGQGTTVTVSS

SEQ ID NO: 239 - protein, 126 aa, Artificial Sequence
  Description of Artificial Sequence: Synthetic polypeptide
QVQLQESGPGLVKPSETLSLTCTVSGDSISSGGYYWSWIRQHPGKGLEWIGYIYYSGSTYYNPSLKSRVTISVDTSKNQFSLKLSSVTAADTAVYYCARDRITIFGVVMGGGMDVWGQGTTVTVSS

SEQ ID NO: 240 - protein, 126 aa, Artificial Sequence; identical to SEQ ID NO: 166
  Description of Artificial Sequence: Synthetic polypeptide

SEQ ID NO: 241 - protein, 126 aa, Artificial Sequence; identical to SEQ ID NO: 239
  Description of Artificial Sequence: Synthetic polypeptide

SEQ ID NO: 242 - protein, 126 aa, Artificial Sequence; identical to SEQ ID NO: 238
  Description of Artificial Sequence: Synthetic polypeptide

SEQ ID NO: 243 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPESGGTDYSQRFQGRVTMTRDTSISTAYMELNRLRSDDTAVYYCAREATIFGMVIVPFDYWGQGTLVTVSS

SEQ ID NO: 244 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWINPESGGTDYSQRFQGRFTMTRDTSISTAYMELNRLRSDDTAVYYCAREATIFGMVIVPFDYWGQGTLVTVSS

SEQ ID NO: 245 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPDAGGTDYSQRFQGRVTMTRDTSISTAYMELNRLRSDDTAVYYCAREATIFGMVIVPFDYWGQGTLVTVSS

SEQ ID NO: 246 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWINPDAGGTDYSQRFQGRFTMTRDTSISTAYMELNRLRSDDTAVYYCAREATIFGMVIVPFDYWGQGTLVTVSS

SEQ ID NO: 247 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPDSGGTDYSQRFQGRVTMTRDTSISTAYMELNRLRSDDTAVYYCAREATIFGMVIVPFDYWGQGTLVTVSS

SEQ ID NO: 248 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPDSGGTDYSQRFQGRFTMTRDTSISTAYMELNRLRSDDTAVYYCAREATIFGMVIVPFDYWGQGTLVTVSS

SEQ ID NO: 249 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWINPDSGGTDYSQRFQGRVTMTRDTSISTAYMELNRLRSDDTAVYYCAREATIFGMVIVPFDYWGQGTLVTVSS

SEQ ID NO: 250 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPDAGGTDYSQRFQGRFTMTRDTSISTAYMELNRLRSDDTAVYYCAREATIFGMVIVPFDYWGQGTLVTVSS

SEQ ID NO: 251 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWINPDAGGTDYSQRFQGRVTMTRDTSISTAYMELNRLRSDDTAVYYCAREATIFGMVIVPFDYWGQGTLVTVSS

SEQ ID NO: 252 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPDAGGTDYSQRFQGRVTMTRDTSISTAYMELNSLRSDDTAVYYCAREATIFGMVIVPFDYWGQGTLVTVSS

SEQ ID NO: 253 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPESGGTDYSQRFQGRVTMTRDTSISTAYMELNSLRSDDTAVYYCAREATIFGMVIVPFDYWGQGTLVTVSS

SEQ ID NO: 254 - protein, 123 aa, Artificial Sequence
  Description of Artificial Sequence: Synthetic polypeptide
QVPLVQSGAEVKKPGASVKVSCKASGYTFTGYYIHWVRQAPGQGLVWMGWISPNSGETSYAQKFQDRVTMTRDTSISTAYMELSRLRSDDTAVYFCAREATIFGMLIVPFDYWGQGTLVTVSS

SEQ ID NO: 255 - protein, 123 aa, Artificial Sequence
  Description of Artificial Sequence: Synthetic polypeptide
QVPLVQSGAEVKKPGASVKVSCKASGYTFTGYYIHWVRQAPGQGLVWMGWISPNSGDTSYAQKFQDRVTMTRDTSISTAYMELSRLRSDDTAVYFCAREATIFGMLIVPFDYWGQGTLVTVSS

SEQ ID NO: 256 - protein, 123 aa, Artificial Sequence; identical to SEQ ID NO: 254
  Description of Artificial Sequence: Synthetic polypeptide

SEQ ID NO: 257 - protein, 123 aa, Artificial Sequence
  Description of Artificial Sequence: Synthetic polypeptide
QVPLVQSGAEVKKPGASVKVSCKASGYTFTGYYIHWVRQAPGQGLVWMGWISPNSGETSYAQKFQDRVTMTRDTSISTAYMELSRLRSDDTAVYFCTREATIFGMLIVPFDYWGQGTLVTVSS

SEQ ID NO: 258 - protein, 123 aa, Artificial Sequence; identical to SEQ ID NO: 164
  Description of Artificial Sequence: Synthetic polypeptide

SEQ ID NO: 259 - protein, 123 aa, Artificial Sequence; identical to SEQ ID NO: 257
  Description of Artificial Sequence: Synthetic polypeptide

SEQ ID NO: 260 - protein, 123 aa, Artificial Sequence; identical to SEQ ID NO: 255
  Description of Artificial Sequence: Synthetic polypeptide

SEQ ID NO: 261 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWISPNSGETSYAQKFQDRVTMTRDTSISTAYMELSSLRSDDTAVYFCAREATIFGMLIVPFDYWGQGTLVTVSS

SEQ ID NO: 262 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWISPNSGETSYAQKFQDRVTMTRDTSISTAYMELSRLRSDDTAVYFCAREATIFGMLIVPFDYWGQGTLVTVSS

SEQ ID NO: 263 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWINPESGGTDYSQRFQGRVTMTRDTSISTAYMELSRLRSDDTAVYYCAREATIFGMVIVPFDYWGQGTLVTVSS

SEQ ID NO: 264 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWINPESGGTDYSQRFQGRFTMTRDTSISTAYMELSRLRSDDTAVYYCAREATIFGMVIVPFDYWGQGTLVTVSS

SEQ ID NO: 265 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWINPDSGGTDYSQRFQGRVTMTRDTSISTAYMELSRLRSDDTAVYYCAREATIFGMVIVPFDYWGQGTLVTVSS

SEQ ID NO: 266 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPESGGTDYSQRFQGRVTMTRDTSISTAYMELSSLRSDDTAVYYCAREATIFGMVIVPFDYWGQGTLVTVSS

SEQ ID NO: 267 - protein, 123 aa, Artificial Sequence; identical to SEQ ID NO: 263
  Description of Artificial Sequence: Synthetic polypeptide

SEQ ID NO: 268 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWISPNQGETNYAQKFQDRVTMTRDTSISTAYMELSRLRSDDTAVYYCAREATIFGMLIVPFDYWGQGTLVTVSS

SEQ ID NO: 269 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWISPNQGDTNYAQKFQDRVTMTRDTSISTAYMELSRLRSDDTAVYYCAREATIFGMLIVPFDYWGQGTLVTVSS

SEQ ID NO: 270 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWISPNQGETNYAQKFQDRVTMTRDTSISTAYMELSRLRSDDTAVYYCTREATIFGMLIVPFDYWGQGTLVTVSS

SEQ ID NO: 271 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWISPNNGETNYAQKFQDRVTMTRDTSISTAYMELSRLRSDDTAVYYCAREATIFGMLIVPFDYWGQGTLVTVSS

SEQ ID NO: 272 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWISPNNGDTNYAQKFQDRVTMTRDTSISTAYMELSRLRSDDTAVYYCAREATIFGMLIVPFDYWGQGTLVTVSS

SEQ ID NO: 273 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWISPNQGDTNYAQKFQDRVTMTRDTSISTAYMELSRLRSDDTAVYYCTREATIFGMLIVPFDYWGQGTLVTVSS

SEQ ID NO: 274 - protein, 123 aa, Artificial Sequence
  Description of Artificial Sequence: Synthetic polypeptide
QVPLVQSGAEVKKPGASVKVSCKASGYTFTGYYIHWVRQAPGQGLEWMGWISPNNGETNYAQKFQDRVTMTRDTSISTAYMELSRLRSDDTAVYYCTREATIFGMLIVPFDYWGQGTLVTVSS

SEQ ID NO: 275 - protein, 123 aa, Artificial Sequence; identical to SEQ ID NO: 268
  Description of Artificial Sequence: Synthetic polypeptide

SEQ ID NO: 276 - protein, 123 aa, Artificial Sequence; identical to SEQ ID NO: 272
  Description of Artificial Sequence: Synthetic polypeptide

SEQ ID NO: 277 - protein, 123 aa, Artificial Sequence; identical to SEQ ID NO: 269
  Description of Artificial Sequence: Synthetic polypeptide

SEQ ID NO: 278 - protein, 123 aa, Artificial Sequence; identical to SEQ ID NO: 271
  Description of Artificial Sequence: Synthetic polypeptide

SEQ ID NO: 279 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWISPNQGETNYAQKFQDRVTMTRDTSISTAYMELSSLRSDDTAVYYCAREATIFGMLIVPFDYWGQGTLVTVSS

SEQ ID NO: 280 - protein, 123 aa, Artificial Sequence; identical to SEQ ID NO: 279
  Description of Artificial Sequence: Synthetic polypeptide

SEQ ID NO: 281 - protein, 128 aa, Artificial Sequence; identical to SEQ ID NO: 158
  Description of Artificial Sequence: Synthetic polypeptide

SEQ ID NO: 282 - protein, 128 aa, Artificial Sequence; identical to SEQ ID NO: 158
  Description of Artificial Sequence: Synthetic polypeptide

SEQ ID NO: 283 - protein, 128 aa, Artificial Sequence; identical to SEQ ID NO: 158
  Description of Artificial Sequence: Synthetic polypeptide

SEQ ID NO: 284 - protein, 128 aa, Artificial Sequence; identical to SEQ ID NO: 158
  Description of Artificial Sequence: Synthetic polypeptide

SEQ ID NO: 285 - protein, 128 aa, Artificial Sequence; identical to SEQ ID NO: 158
  Description of Artificial Sequence: Synthetic polypeptide

SEQ ID NO: 286 - protein, 128 aa, Artificial Sequence; identical to SEQ ID NO: 158
  Description of Artificial Sequence: Synthetic polypeptide

SEQ ID NO: 287 - protein, 128 aa, Artificial Sequence; identical to SEQ ID NO: 158
  Description of Artificial Sequence: Synthetic polypeptide

SEQ ID NO: 288 - protein, 128 aa, Artificial Sequence; identical to SEQ ID NO: 158
  Description of Artificial Sequence: Synthetic polypeptide

SEQ ID NO: 289 - protein, 128 aa, Artificial Sequence; identical to SEQ ID NO: 158
  Description of Artificial Sequence: Synthetic polypeptide

SEQ ID NO: 290 - protein, 128 aa, Artificial Sequence; identical to SEQ ID NO: 158
  Description of Artificial Sequence: Synthetic polypeptide

SEQ ID NO: 291 - protein, 128 aa, Artificial Sequence; identical to SEQ ID NO: 158
  Description of Artificial Sequence: Synthetic polypeptide

SEQ ID NO: 292 - protein, 128 aa, Artificial Sequence; identical to SEQ ID NO: 158
  Description of Artificial Sequence: Synthetic polypeptide

SEQ ID NO: 293 - protein, 128 aa, Artificial Sequence
  Description of Artificial Sequence: Synthetic polypeptide
QMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSS

SEQ ID NO: 294 - protein, 128 aa, Artificial Sequence
  Description of Artificial Sequence: Synthetic polypeptide
QMQVVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGDYVFGTYRPHYYYGMDVWGQGTTVTVSS

SEQ ID NO: 295 - protein, 121 aa, Artificial Sequence; identical to SEQ ID NO: 195
  Description of Artificial Sequence: Synthetic polypeptide

SEQ ID NO: 296 - protein, 121 aa, Artificial Sequence; identical to SEQ ID NO: 177
  Description of Artificial Sequence: Synthetic polypeptide

SEQ ID NO: 297 - protein, 128 aa, Artificial Sequence; identical to SEQ ID NO: 158
  Description of Artificial Sequence: Synthetic polypeptide

SEQ ID NO: 298 - protein, 121 aa, Artificial Sequence
  Description of Artificial Sequence: Synthetic polypeptide
QVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSS

SEQ ID NO: 299 - protein, 129 aa, Artificial Sequence
  Description of Artificial Sequence: Synthetic polypeptide
QMQLVQSGAEVKKPGASVKVSCKASGYTFTSYDINWVRQATGQGLEWMGWMNPNSGNTGYAQKFQGRVTMTRDTSISTAYMELSSLRSQDTAVYYCARGGDYVWGSYRPYYYYYGMDVWGQGTTVTVSS

SEQ ID NO: 300 - protein, 121 aa, Artificial Sequence
  Description of Artificial Sequence: Synthetic polypeptide
QVQLVESGGGVVQPGRSLRLSCAASGFTFSSYGIHWVRQAPGKGLEWVAVIWYDASNKFHADAVKGRFTISRDNSKNTLYLQMNSLRAEDSAMYFCARGKVAGMPEAFEIWGQGTKVTVSS

SEQ ID NO: 301 - protein, 121 aa, Artificial Sequence
  Description of Artificial Sequence: Synthetic polypeptide
QVQLVESGGGVVQPGRSLRLSCTASGFTFSSYGIHWVRQAPGKGLEWVAVIWYDASNKFHADAVKGRFTISRDNSKNTLYLQMNSLRAEDSAMYFCARGKVAGMPEAFEIWGQGTKVTVSS

SEQ ID NO: 302 - protein, 121 aa, Artificial Sequence; identical to SEQ ID NO: 300
  Description of Artificial Sequence: Synthetic polypeptide

SEQ ID NO: 303 - protein, 121 aa, Artificial Sequence
  Description of Artificial Sequence: Synthetic polypeptide
QVQLVESGGGVVQPGRSLRLSCAASGFTFSSYGIHWVRQAPGKGLEWVAVIWYDASNKFHADAVKGRFTISRDNSKNTLYLQMNSLRAEDSAMYFCARGKVAGMPEAFEIWGQGTLVTVSS

SEQ ID NO: 304 - protein, 121 aa, Artificial Sequence
  Description of Artificial Sequence: Synthetic polypeptide
QVQLVESGGGVVQPGRSLRLSCAASGFTFSSYGIHWVRQAPGKGLEWVAVIWYDASNKFHADSVKGRFTISRDNSKNTLYLQMNSLRAEDSAMYFCARGKVAGMPEAFEIWGQGTKVTVSS

SEQ ID NO: 305 - protein, 121 aa, Artificial Sequence
  Description of Artificial Sequence: Synthetic polypeptide
QVQLVESGGGVVQPGRSLRLSCAASGFTFSSYGIHWVRQAPGKGLEWVAVIWYDGSNKFHADAVKGRFTISRDNSKNTLYLQMNSLRAEDSAMYFCARGKVAGMPEAFEIWGQGTKVTVSS

SEQ ID NO: 306 - protein, 129 aa, Artificial Sequence
  Description of Artificial Sequence: Synthetic polypeptide
QMQLVQSGAEVKKPGASVKVSCKASGYTFTSYDINWVRQATGQGLEWMGWMNPNSGGTGYAQKFQGRVTMTRDTSISTAYMELSSLRSQDTAVYYCARGGDYVWGSYRPYYYYYGMDVWGQGTTVTVSS

SEQ ID NO: 307 - protein, 129 aa, Artificial Sequence; identical to SEQ ID NO: 299
  Description of Artificial Sequence: Synthetic polypeptide

SEQ ID NO: 308 - protein, 129 aa, Artificial Sequence; identical to SEQ ID NO: 306
  Description of Artificial Sequence: Synthetic polypeptide

SEQ ID NO: 309 - protein, 129 aa, Artificial Sequence
  Description of Artificial Sequence: Synthetic polypeptide
QMQLVQSGAEVKKPGASVKVSCKASGYTFTSYDINWVRQAPGQGLEWMGWMNPNSGGTGYAQKFQGRVTMTRDTSISTAYMELSSLRSDDTAVYYCARGGDYVWGSYRPYYYYYGMDVWGQGTTVTVSS

SEQ ID NO: 310 - protein, 129 aa, Artificial Sequence; identical to SEQ ID NO: 306
  Description of Artificial Sequence: Synthetic polypeptide

SEQ ID NO: 311 - protein, 129 aa, Artificial Sequence
  Description of Artificial Sequence: Synthetic polypeptide
QMQLVQSGAEVKKPGASVKVSCKASGYTFTSYDINWVRQAPGQGLEWMGWMNPNSGNTGYAQKFQGRVTMTRDTSISTAYMELSSLRSDDTAVYYCARGGDYVWGSYRPYYYYYGMDVWGQGTTVTVSS

SEQ ID NO: 312 - protein, 129 aa, Artificial Sequence
  Description of Artificial Sequence: Synthetic polypeptide
QMQLVQSGAEVKKPGASVKVSCKASGYTFTSYDINWVRQATGQGLEWMGWMNPNSGGTGYAQKFQGRVTMTRDTSISTAYMELSSLRSQDTAVYYCARGGDYVFGSYRPYYYYYGMDVWGQGTTVTVSS

SEQ ID NO: 313 - protein, 129 aa, Artificial Sequence
  Description of Artificial Sequence: Synthetic polypeptide
QMQLVQSGAEVKKPGASVKVSCKASGYTFTSYDINWVRQAPGQGLEWMGWMNPNSGGTGYAQKFQGRVTMTRDTSISTAYMELSSLRSDDTAVYYCARGGDYVFGSYRPYYYYYGMDVWGQGTTVTVSS

SEQ ID NO: 314 - protein, 121 aa, Artificial Sequence; identical to SEQ ID NO: 303
  Description of Artificial Sequence: Synthetic polypeptide

SEQ ID NO: 315 - protein, 216 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 316 - protein, 214 aa, Artificial Sequence
  Description of Artificial Sequence: Synthetic polypeptide
DIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 317 - protein, 214 aa, Artificial Sequence; identical to SEQ ID NO: 316
  Description of Artificial Sequence: Synthetic polypeptide

SEQ ID NO: 318 - protein, 213 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFSFTISSLQPEDIATYYCQQYDILLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 319 - protein, 220 aa, Artificial Sequence
  Description of Artificial Sequence: Synthetic polypeptide
DIVMTQSPDSLAVSLGERATINCKSSQSVLSSSNNKNYIAWYQQQPGHPPKLLIYWASTRESGVPDRFSGSGSGTDFTLTISSLQAEDVAVFYCQQYYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 320 - protein, 220 aa, Artificial Sequence
  Description of Artificial Sequence: Synthetic polypeptide
DIVMTQSPDSLAVSLGERATINCKSSQSVLSSSNNKNYIAWYQQKPGHPPKLLIYWASTRESGVPDRFSGSGSGTDFTLTISSLQAEDVAVFYCQQYYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 321 - protein, 220 aa, Artificial Sequence
  Description of Artificial Sequence: Synthetic polypeptide
DIVMTQSPDSLSVSLGERATINCKSSQSVLSSSNNKNYLAWYQQKPGQPPNLLIYWTSTRDSGVPDRFSGSGSGTDFTLTINSLQAEDVAVYYCQQYYRTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 322 - protein, 220 aa, Artificial Sequence; identical to SEQ ID NO: 321
  Description of Artificial Sequence: Synthetic polypeptide

SEQ ID NO: 323 - protein, 215 aa, Artificial Sequence
  Description of Artificial Sequence: Synthetic polypeptide
EIVLTQSPGTLSLSPGERATLSCRASQSISYSYLAWYQQKPGQAPRLLIYGASSRATGIPDRFSGSGSGTDFTLTISRQEPDDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 324 - protein, 214 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 325 - protein, 214 aa, Artificial Sequence
  Description of Artificial Sequence: Synthetic polypeptide
DIQMTQSPSSLSASVGDRVTITCRASQGIRNELGWYQQKPGKAPKRLIYGASSLQSGVPSRFSGSGSGTEFTLTISSLQPEDFVTYYCLQHNSYPFTFGPGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 213 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTFTISSLQPEDIATYYCQQYDDLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 214 aa, Artificial Sequence
  Description of Artificial Sequence: Synthetic polypeptide
DIQMTQSPSSVSASVGDRVTITCRASQGLIIWLAWYQQKPGKAPKLLIYAASSLQSGVPSRFSGSGSGTDFTLTISSLQPEDFATYYCQQTNSFPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 214 aa, Artificial Sequence; identical to SEQ ID NO: 327
  Description of Artificial Sequence: Synthetic polypeptide

SEQ ID NO: 329 - protein, 214 aa, Artificial Sequence
  Description of Artificial Sequence: Synthetic polypeptide
DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGQGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 214 aa, Artificial Sequence; identical to SEQ ID NO: 329
  Description of Artificial Sequence: Synthetic polypeptide

SEQ ID NO: 331 - protein, 214 aa, Artificial Sequence; identical to SEQ ID NO: 329
  Description of Artificial Sequence: Synthetic polypeptide

SEQ ID NO: 332 - protein, 214 aa, Artificial Sequence
  Description of Artificial Sequence: Synthetic polypeptide
DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGPGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 333 - protein, 214 aa, Artificial Sequence
  Description of Artificial Sequence: Synthetic polypeptide
DIQMTQSPSSLSASVGDRVTITCRASQGIRNELGWYQQKPGKAPKRLIYGASSLQSGVPSRFSGSGSGTEFTLTISSLQPEDFVTYYCLQHNSYPFTFGQGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 334 - protein, 214 aa, Artificial Sequence; identical to SEQ ID NO: 329
  Description of Artificial Sequence: Synthetic polypeptide

SEQ ID NO: 335 - protein, 214 aa, Artificial Sequence
  Description of Artificial Sequence: Synthetic polypeptide
DIQMTQSPSSLSASIGDRVTITCRASQDIRDYLGWYQQKPGKAPKLLIYGASSLQSGVPSRFSGSGSGTEFTLTISSLQPEDFATYYCLQHNNYPFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 336 - protein, 214 aa, Artificial Sequence
  Description of Artificial Sequence: Synthetic polypeptide
DIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 337 - protein, 214 aa, Artificial Sequence
  Description of Artificial Sequence: Synthetic polypeptide
DIQMTQSPSSLSASIGDRVTITCRASQDIRDYLGWYQQKPGKAPKLLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 338 - protein, 214 aa, Artificial Sequence; identical to SEQ ID NO: 335
  Description of Artificial Sequence: Synthetic polypeptide

SEQ ID NO: 339 - protein, 214 aa, Artificial Sequence; identical to SEQ ID NO: 335
  Description of Artificial Sequence: Synthetic polypeptide

SEQ ID NO: 340 - protein, 214 aa, Artificial Sequence; identical to SEQ ID NO: 335
  Description of Artificial Sequence: Synthetic polypeptide

SEQ ID NO: 341 - protein, 214 aa, Artificial Sequence; identical to SEQ ID NO: 335
  Description of Artificial Sequence: Synthetic polypeptide

SEQ ID NO: 342 - protein, 214 aa, Artificial Sequence
  Description of Artificial Sequence: Synthetic polypeptide
DIQMTQSPSSLSASIGDRVTITCRASQDLRNYLGWYHQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 343 - protein, 214 aa, Artificial Sequence
  Description of Artificial Sequence: Synthetic polypeptide
DIQMTQSPSSLSASIGDRVTITCRASQDLRNYLGWYQQKPGKAPKLLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 344 - protein, 214 aa, Artificial Sequence; identical to SEQ ID NO: 343
  Description of Artificial Sequence: Synthetic polypeptide

SEQ ID NO: 345 - protein, 214 aa, Artificial Sequence
  Description of Artificial Sequence: Synthetic polypeptide
DIQMTQSPSSLSASIGDRVTITCRASQDLRNYLGWYHQKPGKAPKLLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 346 - protein, 214 aa, Artificial Sequence
  Description of Artificial Sequence: Synthetic polypeptide
DIQMTQSPSSLSASIGDRVTITCRASQDLRNYLGWYQQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 347 - protein, 214 aa, Artificial Sequence; identical to SEQ ID NO: 346
  Description of Artificial Sequence: Synthetic polypeptide

SEQ ID NO: 348 - protein, 214 aa, Artificial Sequence; identical to SEQ ID NO: 345
  Description of Artificial Sequence: Synthetic polypeptide

SEQ ID NO: 349 - protein, 214 aa, Artificial Sequence; identical to SEQ ID NO: 342
  Description of Artificial Sequence: Synthetic polypeptide

SEQ ID NO: 350 - protein, 214 aa, Artificial Sequence; identical to SEQ ID NO: 343
  Description of Artificial Sequence: Synthetic polypeptide

SEQ ID NO: 351 - protein, 214 aa, Artificial Sequence; identical to SEQ ID NO: 343
  Description of Artificial Sequence: Synthetic polypeptide

SEQ ID NO: 352 - protein, 214 aa, Artificial Sequence
  Description of Artificial Sequence: Synthetic polypeptide
DIQMTQSPSSLSASIGDRVTITCRASQDLRNYLGWYQQKPGKAPKLLIYGASSLQSGVPSRFSGSGSGTEFTLTISSLQPEDFATYYCLQHNNYPFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 353 - protein, 214 aa, Artificial Sequence; identical to SEQ ID NO: 343
  Description of Artificial Sequence: Synthetic polypeptide

SEQ ID NO: 354 - protein, 213 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFSLTISSLQPEDFATYYCQQYDILLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 355 - protein, 213 aa, Artificial Sequence; identical to SEQ ID NO: 354
  Description of Artificial Sequence: Synthetic polypeptide

SEQ ID NO: 356 - protein, 213 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFSLTISSLQPEDIATYYCQQYDILLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 357 - protein, 213 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFSFTISSLQPEDFATYYCQQYDILLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 358 - protein, 213 aa, Artificial Sequence; identical to SEQ ID NO: 356
  Description of Artificial Sequence: Synthetic polypeptide

SEQ ID NO: 359 - protein, 213 aa, Artificial Sequence; identical to SEQ ID NO: 357
  Description of Artificial Sequence: Synthetic polypeptide

SEQ ID NO: 360 - protein, 213 aa, Artificial Sequence; identical to SEQ ID NO: 318
  Description of Artificial Sequence: Synthetic polypeptide

SEQ ID NO: 361 - protein, 213 aa, Artificial Sequence; identical to SEQ ID NO: 354
  Description of Artificial Sequence: Synthetic polypeptide

SEQ ID NO: 362 - protein, 213 aa, Artificial Sequence; identical to SEQ ID NO: 354
  Description of Artificial Sequence: Synthetic polypeptide

SEQ ID NO: 363 - protein, 214 aa, Artificial Sequence; identical to SEQ ID NO: 316
  Description of Artificial Sequence: Synthetic polypeptide

SEQ ID NO: 364 - protein, 214 aa, Artificial Sequence; identical to SEQ ID NO: 316
  Description of Artificial Sequence: Synthetic polypeptide

SEQ ID NO: 365 - protein, 214 aa, Artificial Sequence; identical to SEQ ID NO: 335
  Description of Artificial Sequence: Synthetic polypeptide

SEQ ID NO: 366 - protein, 214 aa, Artificial Sequence; identical to SEQ ID NO: 335
  Description of Artificial Sequence: Synthetic polypeptide

SEQ ID NO: 367 - protein, 214 aa, Artificial Sequence; identical to SEQ ID NO: 337
  Description of Artificial Sequence: Synthetic polypeptide

SEQ ID NO: 368 - protein, 214 aa, Artificial Sequence; identical to SEQ ID NO: 337
  Description of Artificial Sequence: Synthetic polypeptide

SEQ ID NO: 369 - protein, 214 aa, Artificial Sequence; identical to SEQ ID NO: 337
  Description of Artificial Sequence: Synthetic polypeptide

SEQ ID NO: 370 - protein, 213 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTLTISSLQPEDFATYYCQQYDDLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 371 - protein, 213 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTLTISSLQPEDIATYYCQQYDDLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 372 - protein, 213 aa, Artificial Sequence; identical to SEQ ID NO: 370
  Description of Artificial Sequence: Synthetic polypeptide

SEQ ID NO: 373 - protein, 213 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTFTISSLQPEDFATYYCQQYDDLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 374 - protein, 213 aa, Artificial Sequence; identical to SEQ ID NO: 371
  Description of Artificial Sequence: Synthetic polypeptide

SEQ ID NO: 375 - protein, 213 aa, Artificial Sequence; identical to SEQ ID NO: 373
  Description of Artificial Sequence: Synthetic polypeptide

SEQ ID NO: 376 - protein, 213 aa, Artificial Sequence; identical to SEQ ID NO: 326
  Description of Artificial Sequence: Synthetic polypeptide

SEQ ID NO: 377 - protein, 213 aa, Artificial Sequence; identical to SEQ ID NO: 370
  Description of Artificial Sequence: Synthetic polypeptide

SEQ ID NO: 378 - protein, 213 aa, Artificial Sequence; identical to SEQ ID NO: 370
  Description of Artificial Sequence: Synthetic polypeptide

SEQ ID NO: 379 - protein, 213 aa, Artificial Sequence
  Description of Artificial Sequence: Synthetic polypeptide
DIQMTQSPSSLSASVGDRVTITCQASQDITNYLNWYQQKPGKAPKLLIYDASNLEPGVPSRFSGSGSGTDFTLTISSLQPEDFATYYCQQYDDLFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 380 - protein, 213 aa, Artificial Sequence; identical to SEQ ID NO: 379
  Description of Artificial Sequence: Synthetic polypeptide

SEQ ID NO: 381 - protein, 214 aa, Artificial Sequence
  Description of Artificial Sequence: Synthetic polypeptide
EIVLTQSPGTLSLSPGERATLSCRASQIFTSTYLAWYQQKPGQAPRLLIYGASSRATGIPDRFSGSGSGTDFTLTISRLEPEDFAVYYCQQYGSSPRFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 214 aa, Artificial Sequence; identical to SEQ ID NO: 381
  Description of Artificial Sequence: Synthetic polypeptide

SEQ ID NO: 383 - protein, 214 aa, Artificial Sequence; identical to SEQ ID NO: 381
  Description of Artificial Sequence: Synthetic polypeptide

SEQ ID NO: 384 - protein, 214 aa, Artificial Sequence; identical to SEQ ID NO: 381
  Description of Artificial Sequence: Synthetic polypeptide

SEQ ID NO: 385 - protein, 214 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 386 - protein, 214 aa, Artificial Sequence; identical to SEQ ID NO: 385
  Description of Artificial Sequence: Synthetic polypeptide

SEQ ID NO: 387 - protein, 214 aa, Artificial Sequence; identical to SEQ ID NO: 385
  Description of Artificial Sequence: Synthetic polypeptide

SEQ ID NO: 388 - protein, 214 aa, Artificial Sequence; identical to SEQ ID NO: 324
  Description of Artificial Sequence: Synthetic polypeptide

SEQ ID NO: 389 - protein, 214 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARFSGSGSGTEFTLTISSLEPEDFAVYYCQQYNNFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - protein, 214 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARFSGSGSGTEFTLTISSLEPEDFAVYYCQQYNNYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 391 - protein, 214 aa, Artificial Sequence
  Description of Artificial Sequence: Synthetic polypeptide
EIVMTQSPATLSVSPGERATLSCRASQSVSSNLAWYQQKPGQAPRLLIYGAATRATGIPARFSGSGSGTEFTLTISSLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 392 - protein, 214 aa, Artificial Sequence; identical to SEQ ID NO: 391
  Description of Artificial Sequence: Synthetic polypeptide

SEQ ID NO: 393 - protein, 215 aa, Artificial Sequence
  Description of Artificial Sequence: Synthetic polypeptide
EIVLTQSPGTLSLSPGERATLSCRASQSISYSYLAWYQQKPGQAPRLLIYGASSRATGIPDRFSGSGSGTDFTLTISRLEPDDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 394 - protein, 215 aa, Artificial Sequence; identical to SEQ ID NO: 323
  Description of Artificial Sequence: Synthetic polypeptide

SEQ ID NO: 395 - protein, 215 aa, Artificial Sequence; identical to SEQ ID NO: 393
  Description of Artificial Sequence: Synthetic polypeptide

SEQ ID NO: 396 - protein, 215 aa, Artificial Sequence; identical to SEQ ID NO: 393
  Description of Artificial Sequence: Synthetic polypeptide

SEQ ID NO: 397 - protein, 215 aa, Artificial Sequence; identical to SEQ ID NO: 393
  Description of Artificial Sequence: Synthetic polypeptide

SEQ ID NO: 398 - protein, 215 aa, Artificial Sequence; identical to SEQ ID NO: 323
  Description of Artificial Sequence: Synthetic polypeptide

SEQ ID NO: 399 - protein, 215 aa, Artificial Sequence; identical to SEQ ID NO: 323
  Description of Artificial Sequence: Synthetic polypeptide

SEQ ID NO: 400 - protein, 220 aa, Artificial Sequence; identical to SEQ ID NO: 319
  Description of Artificial Sequence: Synthetic polypeptide

SEQ ID NO: 401 - protein, 220 aa, Artificial Sequence; identical to SEQ ID NO: 319
  Description of Artificial Sequence: Synthetic polypeptide

SEQ ID NO: 402 - protein, 220 aa, Artificial Sequence; identical to SEQ ID NO: 319
  Description of Artificial Sequence: Synthetic polypeptide

SEQ ID NO: 403 - protein, 220 aa, Artificial Sequence; identical to SEQ ID NO: 319
  Description of Artificial Sequence: Synthetic polypeptide

SEQ ID NO: 404 - protein, 220 aa, Artificial Sequence; identical to SEQ ID NO: 319
  Description of Artificial Sequence: Synthetic polypeptide

SEQ ID NO: 405 - protein, 220 aa, Artificial Sequence; identical to SEQ ID NO: 319
  Description of Artificial Sequence: Synthetic polypeptide

SEQ ID NO: 406 - protein, 220 aa, Artificial Sequence; identical to SEQ ID NO: 319
  Description of Artificial Sequence: Synthetic polypeptide

SEQ ID NO: 407 - protein, 220 aa, Artificial Sequence; identical to SEQ ID NO: 319
  Description of Artificial Sequence: Synthetic polypeptide

SEQ ID NO: 408 - protein, 220 aa, Artificial Sequence; identical to SEQ ID NO: 319
  Description of Artificial Sequence: Synthetic polypeptide

SEQ ID NO: 409 - protein, 220 aa, Artificial Sequence
  Description of Artificial Sequence: Synthetic polypeptide
DIVMTQSPDSLAVSLGERATINCKSSQSVLSSSNNKNYIAWYQQKPGQPPKLLIYWASTRESGVPDRFSGSGSGTDFTLTISSLQAEDVAVFYCQQYYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 410 - protein, 220 aa, Artificial Sequence; identical to SEQ ID NO: 409
  Description of Artificial Sequence: Synthetic polypeptide

SEQ ID NO: 411 - protein, 220 aa, Artificial Sequence
  Description of Artificial Sequence: Synthetic polypeptide
DIVMTQSPDSLSVSLGERATINCKSSQSVLSSSNNKNYLAWYQQKPGQPPNLLIYWTSTRESGVPDRFSGSGSGTDFTLTINSLQAEDVAVYYCQQYYRTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 412 - protein, 220 aa, Artificial Sequence; identical to SEQ ID NO: 411
  Description of Artificial Sequence: Synthetic polypeptide

SEQ ID NO: 413 - protein, 220 aa, Artificial Sequence; identical to SEQ ID NO: 321
  Description of Artificial Sequence: Synthetic polypeptide

SEQ ID NO: 414 - protein, 220 aa, Artificial Sequence; identical to SEQ ID NO: 411
  Description of Artificial Sequence: Synthetic polypeptide

SEQ ID NO: 415 - protein, 220 aa, Artificial Sequence; identical to SEQ ID NO: 411
  Description of Artificial Sequence: Synthetic polypeptide

SEQ ID NO: 416 - protein, 220 aa, Artificial Sequence; identical to SEQ ID NO: 321
  Description of Artificial Sequence: Synthetic polypeptide

SEQ ID NO: 417 - protein, 220 aa, Artificial Sequence; identical to SEQ ID NO: 321
  Description of Artificial Sequence: Synthetic polypeptide

SEQ ID NO: 418 - protein, 220 aa, Artificial Sequence
  Description of Artificial Sequence: Synthetic polypeptide
DIVMTQSPDSLAVSLGERATINCKSSQSVLSSSNNKNYLAWYQQKPGQPPKLLIYWTSTRESGVPDRFSGSGSGTDFTLTINSLQAEDVAVYYCQQYYRTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - protein, 220 aa, Artificial Sequence; identical to SEQ ID NO: 411
  Description of Artificial Sequence: Synthetic polypeptide

SEQ ID NO: 420 - protein, 220 aa, Artificial Sequence; identical to SEQ ID NO: 320
  Description of Artificial Sequence: Synthetic polypeptide

SEQ ID NO: 421 - protein, 220 aa, Artificial Sequence; identical to SEQ ID NO: 320
  Description of Artificial Sequence: Synthetic polypeptide

SEQ ID NO: 422 - protein, 220 aa, Artificial Sequence; identical to SEQ ID NO: 320
  Description of Artificial Sequence: Synthetic polypeptide

SEQ ID NO: 423 - protein, 220 aa, Artificial Sequence; identical to SEQ ID NO: 409
  Description of Artificial Sequence: Synthetic polypeptide

SEQ ID NO: 424 - protein, 220 aa, Artificial Sequence; identical to SEQ ID NO: 409
  Description of Artificial Sequence: Synthetic polypeptide

SEQ ID NO: 425 - protein, 220 aa, Artificial Sequence; identical to SEQ ID NO: 321
  Description of Artificial Sequence: Synthetic polypeptide

SEQ ID NO: 426 - protein, 220 aa, Artificial Sequence; identical to SEQ ID NO: 321
  Description of Artificial Sequence: Synthetic polypeptide

SEQ ID NO: 427 - protein, 220 aa, Artificial Sequence; identical to SEQ ID NO: 321
  Description of Artificial Sequence: Synthetic polypeptide

SEQ ID NO: 428 - protein, 220 aa, Artificial Sequence; identical to SEQ ID NO: 321
  Description of Artificial Sequence: Synthetic polypeptide

SEQ ID NO: 429 - protein, 220 aa, Artificial Sequence; identical to SEQ ID NO: 321
  Description of Artificial Sequence: Synthetic polypeptide

SEQ ID NO: 430 - protein, 220 aa, Artificial Sequence; identical to SEQ ID NO: 321
  Description of Artificial Sequence: Synthetic polypeptide

SEQ ID NO: 431 - protein, 220 aa, Artificial Sequence; identical to SEQ ID NO: 321
  Description of Artificial Sequence: Synthetic polypeptide

SEQ ID NO: 432 - protein, 220 aa, Artificial Sequence; identical to SEQ ID NO: 411
  Description of Artificial Sequence: Synthetic polypeptide

SEQ ID NO: 433 - protein, 220 aa, Artificial Sequence; identical to SEQ ID NO: 411
  Description of Artificial Sequence: Synthetic polypeptide

SEQ ID NO: 434 - protein, 220 aa, Artificial Sequence; identical to SEQ ID NO: 411
  Description of Artificial Sequence: Synthetic polypeptide

SEQ ID NO: 435 - protein, 220 aa, Artificial Sequence; identical to SEQ ID NO: 411
  Description of Artificial Sequence: Synthetic polypeptide

SEQ ID NO: 436 - protein, 220 aa, Artificial Sequence
  Description of Artificial Sequence: Synthetic polypeptide
DIVMTQSPDSLAVSLGERATINCKSSQSVLSSSNNKNYLAWYQQKPGQPPKLLIYWTSTRDSGVPDRFSGSGSGTDFTLTINSLQAEDVAVYYCQQYYRTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 437 - protein, 220 aa, Artificial Sequence; identical to SEQ ID NO: 418
  Description of Artificial Sequence: Synthetic polypeptide

SEQ ID NO: 438 - protein, 216 aa, Artificial Sequence
  Description of Artificial Sequence: Synthetic polypeptide
QSVLTQPPSASGTPGQRVTISCSGSSSNIGSQTVNWYQHLPGTAPKLLIYTNNQRPSGVPDRFSGSKSGTSASLAISGLQSEDEADYFCATFDESLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 439 - protein, 216 aa, Artificial Sequence
  Description of Artificial Sequence: Synthetic polypeptide
QSVLTQPPSASGTPGQRVTISCSGSSSNIGSQTVNWYQHLPGTAPKLLIYTNNQRPSGVPDRFSGSKSGTSASLAISGLQSEDEADYFCATFDESLQGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 440 - protein, 216 aa, Artificial Sequence
  Description of Artificial Sequence: Synthetic polypeptide
QSVLTQPPSASGTPGQRVTISCSGSSSNIGSNYVNWYQHLPGTAPKLLIYTNNQRPSGVPDRFSGSKSGTSASLAISGLQSEDEADYFCATFDESLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 441 - protein, 216 aa, Artificial Sequence
  Description of Artificial Sequence: Synthetic polypeptide
QSVLTQPPSASGTPGQRVTISCSGSSSNIGSNYVNWYQHLPGTAPKLLIYTNNQRPSGVPDRFSGSKSGTSASLAISGLQSEDEADYFCATFDESLQGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 442 - protein, 216 aa, Artificial Sequence
  Description of Artificial Sequence: Synthetic polypeptide
QSVLTQPPSASGTPGQRVTISCSGSSSNIGSQTVNWYQHLPGTAPKLLIYTNNQRPSGVPDRFSGSKSGTSASLAISGLQSEDEADYFCATFDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 443 - protein, 216 aa, Artificial Sequence
  Description of Artificial Sequence: Synthetic polypeptide
QSVLTQPPSASGTPGQRVTISCSGSSSNIGSNYVNWYQHLPGTAPKLLIYTNNQRPSGVPDRFSGSKSGTSASLAISGLQSEDEADYFCATFDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 444 - protein, 216 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDESLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 445 - protein, 216 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLQGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 446 - protein, 216 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 447 - protein, 216 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 448 - protein, 216 aa, Artificial Sequence
  Description of Artificial Sequence: Synthetic polypeptide
QSVLTQPPSASGTPGQRVTISCSGSSSNIGSNTVNWYQHLPGTAPKLLIYTNNQRPSGVPDRFSGSKSGTSASLAISGLQSEDEADYFCATFDSSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 449 - protein, 216 aa, Artificial Sequence
  Description of Artificial Sequence: Synthetic polypeptide
QSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 450 - protein, 216 aa, Artificial Sequence; identical to SEQ ID NO: 449
  Description of Artificial Sequence: Synthetic polypeptide

SEQ ID NO: 451 - protein, 216 aa, Artificial Sequence; identical to SEQ ID NO: 438
  Description of Artificial Sequence: Synthetic polypeptide

SEQ ID NO: 452 - protein, 214 aa, Artificial Sequence
  Description of Artificial Sequence: Synthetic polypeptide
DIQMTQSPSSLSASIGDRVTITCRASQDLRNYLGWYQQKPGKAPKRLIYGASSLQSGVPSRFSGSGSGTEFTLTISSLQPEDFATYYCLQHNNYPFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 453 - protein, 214 aa, Artificial Sequence; identical to SEQ ID NO: 336
  Description of Artificial Sequence: Synthetic polypeptide

SEQ ID NO: 454 - protein, 216 aa, Artificial Sequence
  Description of Artificial Sequence: Synthetic polypeptide
QSVLTQPPSASGTPGQRVTISCSGSSSNIGSNTVNWYQQLPGTAPKLLIYTNNQRPSGVPDRFSGSKSGTSASLAISGLQSEDEADYFCATFDSSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 455 - protein, 214 aa, Artificial Sequence
  Description of Artificial Sequence: Synthetic polypeptide
DIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 456 - protein, 216 aa, Artificial Sequence
  Description of Artificial Sequence: Synthetic polypeptide
QSVLTQPPSVSAAPGQKVTISCSGSSSNIGNNYVSWYEQFPGTAPKLLIYDNNKRPSGIPDRFSGSKSGTSATLGITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 457 - protein, 214 aa, Artificial Sequence
  Description of Artificial Sequence: Synthetic polypeptide
DIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 458 - protein, 214 aa, Artificial Sequence; identical to SEQ ID NO: 457
  Description of Artificial Sequence: Synthetic polypeptide

SEQ ID NO: 459 - protein, 214 aa, Artificial Sequence; identical to SEQ ID NO: 455
  Description of Artificial Sequence: Synthetic polypeptide

SEQ ID NO: 460 - protein, 214 aa, Artificial Sequence
  Description of Artificial Sequence: Synthetic polypeptide
DIQLTQSPSSLSASVGDRVTITCRASQTISRFLNWYQQKPGKAPKLLIYVASSLQSGVPSRFSGSGSGTDFTLTISSLQPEDFATYYCQQSYSTLISFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 461 - protein, 214 aa, Artificial Sequence; identical to SEQ ID NO: 457
  Description of Artificial Sequence: Synthetic polypeptide

SEQ ID NO: 462 - protein, 214 aa, Artificial Sequence; identical to SEQ ID NO: 457
  Description of Artificial Sequence: Synthetic polypeptide

SEQ ID NO: 463 - protein, 216 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 464 - protein, 216 aa, Artificial Sequence; identical to SEQ ID NO: 463
  Description of Artificial Sequence: Synthetic polypeptide

SEQ ID NO: 465 - protein, 216 aa, Artificial Sequence; identical to SEQ ID NO: 456
  Description of Artificial Sequence: Synthetic polypeptide

SEQ ID NO: 466 - protein, 216 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLAITGLQTGDEADYYCGTFESSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 467 - protein, 216 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 468 - protein, 216 aa, Artificial Sequence; identical to SEQ ID NO: 467
  Description of Artificial Sequence: Synthetic polypeptide

SEQ ID NO: 469 - protein, 216 aa, Artificial Sequence; identical to SEQ ID NO: 463
  Description of Artificial Sequence: Synthetic polypeptide

SEQ ID NO: 470 - protein, 216 aa, Artificial Sequence; identical to SEQ ID NO: 466
  Description of Artificial Sequence: Synthetic polypeptide

SEQ ID NO: 471 - protein, 214 aa, Artificial Sequence
  Description of Artificial Sequence: Synthetic polypeptide
DIQLTQSPSSLSASVGDRVTITCRASQTISRFLNWYQQKPGKAPKLLIYVASSLQSGVPSRFSGSGSGTDFTLTISSLQPEDFATYYCQQSYSTLLSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 472 - protein, 458 aa, Artificial Sequence
  Description of Artificial Sequence: Synthetic polypeptide
QMQVVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGDYVWGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDGSNENYADSVKGRFTISRDNSKNTLYLHMNSLRVADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - protein, 451 aa, Artificial Sequence
  Description of Artificial Sequence: Synthetic polypeptide
QVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 475 - protein, 450 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISSDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 476 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWINPDSGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWINPDSGGTDYSQRFQGRFTMTRDTSISTAYMELSRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 478 - protein, 453 aa, Artificial Sequence
  Description of Artificial Sequence: Synthetic polypeptide
QVPLVQSGAEVKKPGASVKVSCKASGYTFTGYYIHWVRQAPGQGLVWMGWISPNSGDTSYAQKFQDRVTMTRDTSISTAYMELSRLRSDDTAVYFCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWISPNNGDTNYAQKFQDRVTMTRDTSISTAYMELSRLRSDDTAVYYCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 480 - protein, 456 aa, Artificial Sequence
  Description of Artificial Sequence: Synthetic polypeptide
QVQLQESGPGLVKPSQTLSLTCTVSGDSISSGGYYWSWIRQHPGKGLEWIGYIYYSGSTYYNPSLKSRVTISVDTSKNQFSLKLSSVTAADTAVYYCARDRITIFGVVMGGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - protein, 450 aa, Artificial Sequence
  Description of Artificial Sequence: Synthetic polypeptide
QVQLVESGGGVVQPGRSLRLSCAASGFTFSNYGMHWVRQAPGEGLEWVAAIWFDGSDKYYADSVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 451 aa, Artificial Sequence; identical to SEQ ID NO: 474
  Description of Artificial Sequence: Synthetic polypeptide

SEQ ID NO: 483 - protein, 450 aa, Artificial Sequence
  Description of Artificial Sequence: Synthetic polypeptide
QVQLVESGGGVVQPGRSLRLSCAASGFSFSSYGMHWVRQPPGKGLEWVAAIWYDGNNKYYADSVKGRFTISRDSSKNTLYLQMNSLRAEDTAVYYCARDRTIFGVVLEYLGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 484 - protein, 447 aa, Artificial Sequence
  Description of Artificial Sequence: Synthetic polypeptide
QVQLQESGPGLVKPSETLSLTCTVSQGSISSYYWSWIRQPAGKGLEWIGRIYTSGSTNYNPSLKSRVTMSIDTSKNQFSLKLNSVTAADTAVYYCARDVAVAGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 447 aa, Artificial Sequence
  Description of Artificial Sequence: Synthetic polypeptide
QVQLQESGPGLVKPSETLSLTCTVSGGSISSYYWSWIRQPAGKGLEWIGRIYTSGSTNYNPSLKSRVTMSIDTSKNQFSLKLNSVTAADTAVYYCARDVAVAGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 486 - protein, 451 aa, Artificial Sequence
  Description of Artificial Sequence: Synthetic polypeptide
QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 487 - protein, 451 aa, Artificial Sequence
  Description of Artificial Sequence: Synthetic polypeptide
QVQLVESGGGVVQPGRSLRLSCAASGFTFSYFGMHWVRQAPGKGLEWVAVIWYDASNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 488 - protein, 451 aa, Artificial Sequence
  Description of Artificial Sequence: Synthetic polypeptide
QVQLVESGGGVVQPGRSLRLSCAASGFTFSYFGMHWVRQAPGKGLEWVAVIWYDGSNKYYADAVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - protein, 451 aa, Artificial Sequence; identical to SEQ ID NO: 486
  Description of Artificial Sequence: Synthetic polypeptide

SEQ ID NO: 490 - protein, 451 aa, Artificial Sequence; identical to SEQ ID NO: 486
  Description of Artificial Sequence: Synthetic polypeptide

SEQ ID NO: 491 - protein, 451 aa, Artificial Sequence
  Description of Artificial Sequence: Synthetic polypeptide
QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDRTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 492 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRVADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - protein, 451 aa, Artificial Sequence; identical to SEQ ID NO: 492
  Description of Artificial Sequence: Synthetic polypeptide

SEQ ID NO: 494 - protein, 451 aa, Artificial Sequence; identical to SEQ ID NO: 492
  Description of Artificial Sequence: Synthetic polypeptide

SEQ ID NO: 495 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADSVKGRFTISRDNSKNTLYLHMNSLRVADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 496 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDGSNENYADAVKGRFTISRDNSKNTLYLHMNSLRVADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRVEDTAVYYCARDRTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 498 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRVEDTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 499 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDGSNENYADSVKGRFTISRDNSKNTLYLHMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 500 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLHMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 502 - protein, 451 aa, Artificial Sequence; identical to SEQ ID NO: 500
  Description of Artificial Sequence: Synthetic polypeptide

SEQ ID NO: 503 - protein, 451 aa, Artificial Sequence; identical to SEQ ID NO: 500
  Description of Artificial Sequence: Synthetic polypeptide

SEQ ID NO: 504 - protein, 451 aa, Artificial Sequence; identical to SEQ ID NO: 501
  Description of Artificial Sequence: Synthetic polypeptide

SEQ ID NO: 505 - protein, 451 aa, Artificial Sequence; identical to SEQ ID NO: 501
  Description of Artificial Sequence: Synthetic polypeptide

SEQ ID NO: 506 - protein, 451 aa, Artificial Sequence; identical to SEQ ID NO: 500
  Description of Artificial Sequence: Synthetic polypeptide

SEQ ID NO: 507 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDGSNENYADAVKGRFTISRDNSKNTLYLQMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 508 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADSVKGRFTISRDNSKNTLYLQMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 509 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRAEDTAVYYCARDRTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 510 - protein, 451 aa, Artificial Sequence
  Description of Artificial Sequence: Synthetic polypeptide
QVQLVESGGGVVQPGRSLRLSCAASGFTFSNFGMHWVRQAPGKGLEWVAVIWYDASNENYADAVKGRFTISRDNSKNTLYLQMNSLRAEDTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 511 - protein, 450 aa, Artificial Sequence
  Description of Artificial Sequence: Synthetic polypeptide
QVQLVESGGGVVQPGRSLRLSCAASGFTFSSYGMHWVRQAPGKGLEWVAVIWYDASNKYYADAVKGRFTISRDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 512 - protein, 450 aa, Artificial Sequence
  Description of Artificial Sequence: Synthetic polypeptide
QVQLVESGGGVVQPGRSLRLSCAASGFTFSSYGMHWVRQAPGKGLEWVAVIWYDASNKYYADAVKGRFTISSDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 513 - protein, 450 aa, Artificial Sequence; identical to SEQ ID NO: 511
  Description of Artificial Sequence: Synthetic polypeptide

SEQ ID NO: 514 - protein, 450 aa, Artificial Sequence; identical to SEQ ID NO: 511
  Description of Artificial Sequence: Synthetic polypeptide

SEQ ID NO: 515 - protein, 450 aa, Artificial Sequence; identical to SEQ ID NO: 512
  Description of Artificial Sequence: Synthetic polypeptide

SEQ ID NO: 516 - protein, 450 aa, Artificial Sequence; identical to SEQ ID NO: 512
  Description of Artificial Sequence: Synthetic polypeptide

SEQ ID NO: 517 - protein, 450 aa, Artificial Sequence; identical to SEQ ID NO: 511
  Description of Artificial Sequence: Synthetic polypeptide

SEQ ID NO: 518 - protein, 450 aa, Artificial Sequence
  Description of Artificial Sequence: Synthetic polypeptide
QVQLVESGGGVVQPGRSLRLSCAASGFTFSSYGMHWVRQAPGKGLEWVAVIWYDASNKYYADSVKGRFTISRDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 519 - protein, 450 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADAVKGRFTISRDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 520 - protein, 451 aa, Artificial Sequence; identical to SEQ ID NO: 486
  Description of Artificial Sequence: Synthetic polypeptide

SEQ ID NO: 521 - protein, 451 aa, Artificial Sequence; identical to SEQ ID NO: 491
  Description of Artificial Sequence: Synthetic polypeptide

SEQ ID NO: 522 - protein, 451 aa, Artificial Sequence; identical to SEQ ID NO: 486
  Description of Artificial Sequence: Synthetic polypeptide

SEQ ID NO: 523 - protein, 451 aa, Artificial Sequence; identical to SEQ ID NO: 491
  Description of Artificial Sequence: Synthetic polypeptide

SEQ ID NO: 524 - protein, 451 aa, Artificial Sequence; identical to SEQ ID NO: 474
  Description of Artificial Sequence: Synthetic polypeptide

SEQ ID NO: 525 - protein, 451 aa, Artificial Sequence; identical to SEQ ID NO: 487
  Description of Artificial Sequence: Synthetic polypeptide

SEQ ID NO: 526 - protein, 451 aa, Artificial Sequence; identical to SEQ ID NO: 488
  Description of Artificial Sequence: Synthetic polypeptide

SEQ ID NO: 527 - protein, 450 aa, Artificial Sequence
  Description of Artificial Sequence: Synthetic polypeptide
QVQLVESGGGVVQPGRSLRLSCAASGFSFSSYGMHWVRQPPGKGLEWVAAIWYDANNKYYADAVKGRFTISRDSSKNTLYLQMNSLRAEDTAVYYCARDRTIFGVVLEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 528 - protein, 450 aa, Artificial Sequence; identical to SEQ ID NO: 527
  Description of Artificial Sequence: Synthetic polypeptide

SEQ ID NO: 529 - protein, 450 aa, Artificial Sequence
  Description of Artificial Sequence: Synthetic polypeptide
QVQLVESGGGVVQPGRSLRLSCAASGFSFSSYGMHWVRQPPGKGLEWVAAIWYDANNKYYADAVKGRFTISRDSSKNTLYLQMNSLRAEDTAVYYCARDRTIFGVVLEYLGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 530 - protein, 450 aa, Artificial Sequence; identical to SEQ ID NO: 527
  Description of Artificial Sequence: Synthetic polypeptide

SEQ ID NO: 531 - protein, 450 aa, Artificial Sequence; identical to SEQ ID NO: 529
  Description of Artificial Sequence: Synthetic polypeptide

SEQ ID NO: 532 - protein, 450 aa, Artificial Sequence; identical to SEQ ID NO: 529
  Description of Artificial Sequence: Synthetic polypeptide

SEQ ID NO: 533 - protein, 450 aa, Artificial Sequence; identical to SEQ ID NO: 527
  Description of Artificial Sequence: Synthetic polypeptide

SEQ ID NO: 534 - protein, 450 aa, Artificial Sequence
  Description of Artificial Sequence: Synthetic polypeptide
QVQLVESGGGVVQPGRSLRLSCAASGFSFSSYGMHWVRQPPGKGLEWVAAIWYDGNNKYYADAVKGRFTISRDSSKNTLYLQMNSLRAEDTAVYYCARDRTIFGVVLEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 535 - protein, 450 aa, Artificial Sequence
  Description of Artificial Sequence: Synthetic polypeptide
QVQLVESGGGVVQPGRSLRLSCAASGFSFSSYGMHWVRQPPGKGLEWVAAIWYDANNKYYADSVKGRFTISRDSSKNTLYLQMNSLRAEDTAVYYCARDRTIFGVVLEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 536 - protein, 450 aa, Artificial Sequence; identical to SEQ ID NO: 527
  Description of Artificial Sequence: Synthetic polypeptide

SEQ ID NO: 537 - protein, 450 aa, Artificial Sequence; identical to SEQ ID NO: 529
  Description of Artificial Sequence: Synthetic polypeptide

SEQ ID NO: 538 - protein, 450 aa, Artificial Sequence
  Description of Artificial Sequence: Synthetic polypeptide
QVQLVESGGGVVQPGRSLRLSCAASGFSFSSYGMHWVRQAPGKGLEWVAVIWYDASNKYYEDAVKGRFTISRDNSKNTLFLQVNSLRAEDTAVYYCARGITIFGHGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 539 - protein, 450 aa, Artificial Sequence
  Description of Artificial Sequence: Synthetic polypeptide
QVQLVESGGGVVQPGRSLRLSCAASGFSFSSYGMHWVRQAPGKGLEWVAVIWYDGSNKYYEDSVKGRFTISRDNSKNTLFLQVNSLRAEDTAVYYCARGITIFGHGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 450 aa, Artificial Sequence
  Description of Artificial Sequence: Synthetic polypeptide
QVQLVESGGGVVQPGRSLRLSCAASGFSFSSYGMHWVRQAPGKGLEWVAVIWYDGSNKYYEDAVKGRFTISRDNSKNTLFLQVNSLRAEDTAVYYCARGITIFGHGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 541 - protein, 450 aa, Artificial Sequence
  Description of Artificial Sequence: Synthetic polypeptide
QVQLVESGGGVVQPGRSLRLSCAASGFSFSSYGMHWVRQAPGKGLEWVAVIWYDASNKYYEDSVKGRFTISRDNSKNTLFLQVNSLRAEDTAVYYCARGITIFGHGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 542 - protein, 450 aa, Artificial Sequence
  Description of Artificial Sequence: Synthetic polypeptide
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 543 - protein, 450 aa, Artificial Sequence
  Description of Artificial Sequence: Synthetic polypeptide
QVQLVESGGGVVQPGRSLRLSCAASGFTFSNYGMHWVRQAPGEGLEWVAAIWFDASDKYYADSVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 544 - protein, 450 aa, Artificial Sequence
  Description of Artificial Sequence: Synthetic polypeptide
QVQLVESGGGVVQPGRSLRLSCAASGFTFSNYGMHWVRQAPGEGLEWVAAIWFDGSDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 545 - protein, 450 aa, Artificial Sequence; identical to SEQ ID NO: 542
  Description of Artificial Sequence: Synthetic polypeptide

SEQ ID NO: 546 - protein, 450 aa, Artificial Sequence
  Description of Artificial Sequence: Synthetic polypeptide
QVQLVESGGGVVQPGRSLRLSCAASGFTFSNYGMHWVRQAPGKGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 547 - protein, 450 aa, Artificial Sequence; identical to SEQ ID NO: 546
  Description of Artificial Sequence: Synthetic polypeptide

SEQ ID NO: 548 - protein, 450 aa, Artificial Sequence; identical to SEQ ID NO: 542
  Description of Artificial Sequence: Synthetic polypeptide

SEQ ID NO: 549 - protein, 450 aa, Artificial Sequence; identical to SEQ ID NO: 546
  Description of Artificial Sequence: Synthetic polypeptide

SEQ ID NO: 550 - protein, 456 aa, Artificial Sequence
  Description of Artificial Sequence: Synthetic polypeptide
QVQLQESGPGLVKPSETLSLTCTVSGDSISSGGYYWSWIRQPPGKGLEWIGYIYYSGSTYYNPSLKSRVTISVDTSKNQFSLKLSSVTAADTAVYYCARDRITIFGVVMGGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 551 - protein, 456 aa, Artificial Sequence; identical to SEQ ID NO: 550
  Description of Artificial Sequence: Synthetic polypeptide

SEQ ID NO: 552 - protein, 456 aa, Artificial Sequence
  Description of Artificial Sequence: Synthetic polypeptide
QVQLQESGPGLVKPSQTLSLTCTVSGDSISSGGYYWSWIRQPPGKGLEWIGYIYYSGSTYYNPSLKSRVTISVDTSKNQFSLKLSSVTAADTAVYYCARDRITIFGVVMGGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 553 - protein, 456 aa, Artificial Sequence
  Description of Artificial Sequence: Synthetic polypeptide
QVQLQESGPGLVKPSETLSLTCTVSGDSISSGGYYWSWIRQHPGKGLEWIGYIYYSGSTYYNPSLKSRVTISVDTSKNQFSLKLSSVTAADTAVYYCARDRITIFGVVMGGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 554 - protein, 456 aa, Artificial Sequence; identical to SEQ ID NO: 480
  Description of Artificial Sequence: Synthetic polypeptide

SEQ ID NO: 555 - protein, 456 aa, Artificial Sequence; identical to SEQ ID NO: 553
  Description of Artificial Sequence: Synthetic polypeptide

SEQ ID NO: 556 - protein, 456 aa, Artificial Sequence; identical to SEQ ID NO: 552
  Description of Artificial Sequence: Synthetic polypeptide

SEQ ID NO: 557 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWINPESGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 558 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWINPESGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 559 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWINPDAGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 560 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWINPDAGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 561 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWINPDSGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWINPDSGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 563 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWINPDSGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 564 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWINPDAGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 565 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWINPDAGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 566 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWINPDAGGTDYSQRFQGRVTMTRDTSISTAYMELNSLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 567 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWINPESGGTDYSQRFQGRVTMTRDTSISTAYMELNSLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 568 - protein, 453 aa, Artificial Sequence
  Description of Artificial Sequence: Synthetic polypeptide
QVPLVQSGAEVKKPGASVKVSCKASGYTFTGYYIHWVRQAPGQGLVWMGWISPNSGETSYAQKFQDRVTMTRDTSISTAYMELSRLRSDDTAVYFCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 569 - protein, 453 aa, Artificial Sequence
  Description of Artificial Sequence: Synthetic polypeptide
QVPLVQSGAEVKKPGASVKVSCKASGYTFTGYYIHWVRQAPGQGLVWMGWISPNSGDTSYAQKFQDRVTMTRDTSISTAYMELSRLRSDDTAVYFCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 570 - protein, 453 aa, Artificial Sequence; identical to SEQ ID NO: 568
  Description of Artificial Sequence: Synthetic polypeptide

SEQ ID NO: 571 - protein, 453 aa, Artificial Sequence
  Description of Artificial Sequence: Synthetic polypeptide
QVPLVQSGAEVKKPGASVKVSCKASGYTFTGYYIHWVRQAPGQGLVWMGWISPNSGETSYAQKFQDRVTMTRDTSISTAYMELSRLRSDDTAVYFCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 572 - protein, 453 aa, Artificial Sequence; identical to SEQ ID NO: 478
  Description of Artificial Sequence: Synthetic polypeptide

SEQ ID NO: 573 - protein, 453 aa, Artificial Sequence; identical to SEQ ID NO: 571
  Description of Artificial Sequence: Synthetic polypeptide

SEQ ID NO: 574 - protein, 453 aa, Artificial Sequence; identical to SEQ ID NO: 569
  Description of Artificial Sequence: Synthetic polypeptide

SEQ ID NO: 575 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWISPNSGETSYAQKFQDRVTMTRDTSISTAYMELSSLRSDDTAVYFCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 576 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWISPNSGETSYAQKFQDRVTMTRDTSISTAYMELSRLRSDDTAVYFCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 577 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWINPESGGTDYSQRFQGRVTMTRDTSISTAYMELSRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 578 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWINPESGGTDYSQRFQGRFTMTRDTSISTAYMELSRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 579 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWINPDSGGTDYSQRFQGRVTMTRDTSISTAYMELSRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 580 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWINPESGGTDYSQRFQGRVTMTRDTSISTAYMELSSLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 581 - protein, 453 aa, Artificial Sequence; identical to SEQ ID NO: 577
  Description of Artificial Sequence: Synthetic polypeptide

SEQ ID NO: 582 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWISPNQGETNYAQKFQDRVTMTRDTSISTAYMELSRLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 583 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWISPNQGDTNYAQKFQDRVTMTRDTSISTAYMELSRLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 584 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWISPNQGETNYAQKFQDRVTMTRDTSISTAYMELSRLRSDDTAVYYCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 585 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWISPNNGETNYAQKFQDRVTMTRDTSISTAYMELSRLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 586 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWISPNNGDTNYAQKFQDRVTMTRDTSISTAYMELSRLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 587 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWISPNQGDTNYAQKFQDRVTMTRDTSISTAYMELSRLRSDDTAVYYCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 588 - protein, 453 aa, Artificial Sequence
  Description of Artificial Sequence: Synthetic polypeptide
QVPLVQSGAEVKKPGASVKVSCKASGYTFTGYYIHWVRQAPGQGLEWMGWISPNNGETNYAQKFQDRVTMTRDTSISTAYMELSRLRSDDTAVYYCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 589 - protein, 453 aa, Artificial Sequence; identical to SEQ ID NO: 582
  Description of Artificial Sequence: Synthetic polypeptide

SEQ ID NO: 590 - protein, 453 aa, Artificial Sequence; identical to SEQ ID NO: 586
  Description of Artificial Sequence: Synthetic polypeptide

SEQ ID NO: 591 - protein, 453 aa, Artificial Sequence; identical to SEQ ID NO: 583
  Description of Artificial Sequence: Synthetic polypeptide

SEQ ID NO: 592 - protein, 453 aa, Artificial Sequence; identical to SEQ ID NO: 585
  Description of Artificial Sequence: Synthetic polypeptide

SEQ ID NO: 593 - protein, 453 aa, Artificial Sequence
  Description of Artificial Sequence: Synthetic polypeptide
QVQLVQSGAEVKKPGASVKVSCKASGYTFTGYYIHWVRQAPGQGLEWMGWISPNQGETNYAQKFQDRVTMTRDTSISTAYMELSSLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 594 - protein, 453 aa, Artificial Sequence; identical to SEQ ID NO: 593
  Description of Artificial Sequence: Synthetic polypeptide

SEQ ID NO: 595 - protein, 458 aa, Artificial Sequence; identical to SEQ ID NO: 472
  Description of Artificial Sequence: Synthetic polypeptide

SEQ ID NO: 596 - protein, 458 aa, Artificial Sequence; identical to SEQ ID NO: 472
  Description of Artificial Sequence: Synthetic polypeptide

SEQ ID NO: 597 - protein, 458 aa, Artificial Sequence; identical to SEQ ID NO: 472
  Description of Artificial Sequence: Synthetic polypeptide

SEQ ID NO: 598 - protein, 458 aa, Artificial Sequence; identical to SEQ ID NO: 472
  Description of Artificial Sequence: Synthetic polypeptide

SEQ ID NO: 599 - protein, 458 aa, Artificial Sequence; identical to SEQ ID NO: 472
  Description of Artificial Sequence: Synthetic polypeptide

SEQ ID NO: 600 - protein, 458 aa, Artificial Sequence; identical to SEQ ID NO: 472
  Description of Artificial Sequence: Synthetic polypeptide

SEQ ID NO: 601 - protein, 458 aa, Artificial Sequence; identical to SEQ ID NO: 472
  Description of Artificial Sequence: Synthetic polypeptide

SEQ ID NO: 602 - protein, 458 aa, Artificial Sequence; identical to SEQ ID NO: 472
  Description of Artificial Sequence: Synthetic polypeptide

SEQ ID NO: 603 - protein, 458 aa, Artificial Sequence; identical to SEQ ID NO: 472
  Description of Artificial Sequence: Synthetic polypeptide

SEQ ID NO: 604 - protein, 458 aa, Artificial Sequence; identical to SEQ ID NO: 472
  Description of Artificial Sequence: Synthetic polypeptide

SEQ ID NO: 605 - protein, 458 aa, Artificial Sequence; identical to SEQ ID NO: 472
  Description of Artificial Sequence: Synthetic polypeptide

SEQ ID NO: 606 - protein, 458 aa, Artificial Sequence; identical to SEQ ID NO: 472
  Description of Artificial Sequence: Synthetic polypeptide

SEQ ID NO: 607 - protein, 458 aa, Artificial Sequence
  Description of Artificial Sequence: Synthetic polypeptide
QMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 608 - protein, 458 aa, Artificial Sequence
  Description of Artificial Sequence: Synthetic polypeptide
QMQVVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 609 - protein, 451 aa, Artificial Sequence; identical to SEQ ID NO: 509
  Description of Artificial Sequence: Synthetic polypeptide

SEQ ID NO: 610 - protein, 451 aa, Artificial Sequence; identical to SEQ ID NO: 491
  Description of Artificial Sequence: Synthetic polypeptide

SEQ ID NO: 611 - protein, 458 aa, Artificial Sequence; identical to SEQ ID NO: 472
  Description of Artificial Sequence: Synthetic polypeptide

SEQ ID NO: 612 - protein, 451 aa, Artificial Sequence
  Description of Artificial Sequence: Synthetic polypeptide
QVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 613 - protein, 459 aa, Artificial Sequence
  Description of Artificial Sequence: Synthetic polypeptide
QMQLVQSGAEVKKPGASVKVSCKASGYTFTSYDINWVRQATGQGLEWMGWMNPNSGNTGYAQKFQGRVTMTRDTSISTAYMELSSLRSQDTAVYYCARGGDYVWGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 614 - protein, 451 aa, Artificial Sequence
  Description of Artificial Sequence: Synthetic polypeptide
QVQLVESGGGVVQPGRSLRLSCAASGFTFSSYGIHWVRQAPGKGLEWVAVIWYDASNKFHADAVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 615 - protein, 451 aa, Artificial Sequence
  Description of Artificial Sequence: Synthetic polypeptide
QVQLVESGGGVVQPGRSLRLSCTASGFTFSSYGIHWVRQAPGKGLEWVAVIWYDASNKFHADAVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 616 - protein, 451 aa, Artificial Sequence; identical to SEQ ID NO: 614
  Description of Artificial Sequence: Synthetic polypeptide

SEQ ID NO: 617 - protein, 451 aa, Artificial Sequence
  Description of Artificial Sequence: Synthetic polypeptide
QVQLVESGGGVVQPGRSLRLSCAASGFTFSSYGIHWVRQAPGKGLEWVAVIWYDASNKFHADAVKGRFTISRDNSKNTLYLQMNSLRAEDSAMYFCARGKVAGMPEAFEIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 618 - protein, 451 aa, Artificial Sequence
  Description of Artificial Sequence: Synthetic polypeptide
QVQLVESGGGVVQPGRSLRLSCAASGFTFSSYGIHWVRQAPGKGLEWVAVIWYDASNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 619 - protein, 451 aa, Artificial Sequence
  Description of Artificial Sequence: Synthetic polypeptide
QVQLVESGGGVVQPGRSLRLSCAASGFTFSSYGIHWVRQAPGKGLEWVAVIWYDGSNKFHADAVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 620 - protein, 459 aa, Artificial Sequence
  Description of Artificial Sequence: Synthetic polypeptide
QMQLVQSGAEVKKPGASVKVSCKASGYTFTSYDINWVRQATGQGLEWMGWMNPNSGGTGYAQKFQGRVTMTRDTSISTAYMELSSLRSQDTAVYYCARGGDYVWGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 621 - protein, 459 aa, Artificial Sequence; identical to SEQ ID NO: 613
  Description of Artificial Sequence: Synthetic polypeptide

SEQ ID NO: 622 - protein, 459 aa, Artificial Sequence; identical to SEQ ID NO: 620
  Description of Artificial Sequence: Synthetic polypeptide

SEQ ID NO: 623 - protein, 459 aa, Artificial Sequence
  Description of Artificial Sequence: Synthetic polypeptide
QMQLVQSGAEVKKPGASVKVSCKASGYTFTSYDINWVRQAPGQGLEWMGWMNPNSGGTGYAQKFQGRVTMTRDTSISTAYMELSSLRSDDTAVYYCARGGDYVWGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 624 - protein, 459 aa, Artificial Sequence; identical to SEQ ID NO: 620
  Description of Artificial Sequence: Synthetic polypeptide

SEQ ID NO: 625 - protein, 459 aa, Artificial Sequence
  Description of Artificial Sequence: Synthetic polypeptide
QMQLVQSGAEVKKPGASVKVSCKASGYTFTSYDINWVRQAPGQGLEWMGWMNPNSGNTGYAQKFQGRVTMTRDTSISTAYMELSSLRSDDTAVYYCARGGDYVWGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 626 - protein, 459 aa, Artificial Sequence
  Description of Artificial Sequence: Synthetic polypeptide
QMQLVQSGAEVKKPGASVKVSCKASGYTFTSYDINWVRQATGQGLEWMGWMNPNSGGTGYAQKFQGRVTMTRDTSISTAYMELSSLRSQDTAVYYCARGGDYVFGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 627 - protein, 459 aa, Artificial Sequence
  Description of Artificial Sequence: Synthetic polypeptide
QMQLVQSGAEVKKPGASVKVSCKASGYTFTSYDINWVRQAPGQGLEWMGWMNPNSGGTGYAQKFQGRVTMTRDTSISTAYMELSSLRSDDTAVYYCARGGDYVFGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 628 - protein, 451 aa, Artificial Sequence; identical to SEQ ID NO: 617
  Description of Artificial Sequence: Synthetic polypeptide

SEQ ID NO: 629 - protein, 13 aa, Artificial Sequence
  Description of Artificial Sequence: Synthetic peptide
SGSSSNIGSNTVN

SEQ ID NO: 630 - protein, 11 aa, Artificial Sequence
  Description of Artificial Sequence: Synthetic peptide
RASQDIRDYLG

SEQ ID NO: 631 - protein, 11 aa, Artificial Sequence
  Description of Artificial Sequence: Synthetic peptide
RASQDIRDYLG

SEQ ID NO: 632 - protein, 11 aa, Artificial Sequence
  Description of Artificial Sequence: Synthetic peptide
QASQDISNYLN

SEQ ID NO: 633 - protein, 17 aa, Artificial Sequence
  Description of Artificial Sequence: Synthetic peptide
KSSQSVLSSSNNKNYIA

SEQ ID NO: 634 - protein, 17 aa, Artificial Sequence
  Description of Artificial Sequence: Synthetic peptide
KSSQSVLSSSNNKNYIA

SEQ ID NO: 635 - protein, 17 aa, Artificial Sequence
  Description of Artificial Sequence: Synthetic peptide
KSSQSVLSSSNNKNYLA

SEQ ID NO: 636 - protein, 17 aa, Artificial Sequence
  Description of Artificial Sequence: Synthetic peptide
KSSQSVLSSSNNKNYLA

SEQ ID NO: 637 - protein, 12 aa, Artificial Sequence
  Description of Artificial Sequence: Synthetic peptide
RASQSISYSYLA

SEQ ID NO: 638 - protein, 11 aa, Artificial Sequence
  Description of Artificial Sequence: Synthetic peptide
RASQSVSSNLA

SEQ ID NO: 639 - protein, 11 aa, Artificial Sequence
  Description of Artificial Sequence: Synthetic peptide
RASQGIRNELG

SEQ ID NO: 640 - protein, 11 aa, Artificial Sequence
  Description of Artificial Sequence: Synthetic peptide
QASQDITNYLN

SEQ ID NO: 641 - protein, 11 aa, Artificial Sequence
  Description of Artificial Sequence: Synthetic peptide
RASQGLIIWLA

SEQ ID NO: 642 - protein, 11 aa, Artificial Sequence
  Description of Artificial Sequence: Synthetic peptide
RASQGLIIWLA

SEQ ID NO: 643 - protein, 11 aa, Artificial Sequence
  Description of Artificial Sequence: Synthetic peptide
RASQGIRNELG

SEQ ID NO: 644 - protein, 11 aa, Artificial Sequence
  Description of Artificial Sequence: Synthetic peptide
RASQGIRNELG

SEQ ID NO: 645 - protein, 11 aa, Artificial Sequence
  Description of Artificial Sequence: Synthetic peptide
RASQGIRNELG

SEQ ID NO: 646 - protein, 11 aa, Artificial Sequence
  Description of Artificial Sequence: Synthetic peptide
RASQGIRNELG

SEQ ID NO: 647 - protein, 11 aa, Artificial Sequence
  Description of Artificial Sequence: Synthetic peptide
RASQGIRNELG

SEQ ID NO: 648 - protein, 11 aa, Artificial Sequence
  Description of Artificial Sequence: Synthetic peptide
RASQGIRNELG

SEQ ID NO: 649 - protein, 11 aa, Artificial Sequence
  Description of Artificial Sequence: Synthetic peptide
RASQDIRDYLG

SEQ ID NO: 650 - protein, 11 aa, Artificial Sequence
  Description of Artificial Sequence: Synthetic peptide
RASQDIRDYLG

SEQ ID NO: 651 - protein, 11 aa, Artificial Sequence
  Description of Artificial Sequence: Synthetic peptide
RASQDIRDYLG

SEQ ID NO: 652 - protein, 11 aa, Artificial Sequence
  Description of Artificial Sequence: Synthetic peptide
RASQDIRDYLG

SEQ ID NO: 653 - protein, 11 aa, Artificial Sequence
  Description of Artificial Sequence: Synthetic peptide
RASQDIRDYLG

SEQ ID NO: 654 - protein, 11 aa, Artificial Sequence
  Description of Artificial Sequence: Synthetic peptide
RASQDIRDYLG

SEQ ID NO: 655 - protein, 11 aa, Artificial Sequence
  Description of Artificial Sequence: Synthetic peptide
RASQDIRDYLG

SEQ ID NO: 656 - protein, 11 aa, Artificial Sequence
  Description of Artificial Sequence: Synthetic peptide
RASQDLRNYLG

SEQ ID NO: 657 - protein, 11 aa, Artificial Sequence
  Description of Artificial Sequence: Synthetic peptide
RASQDLRNYLG

SEQ ID NO: 658 - protein, 11 aa, Artificial Sequence
  Description of Artificial Sequence: Synthetic peptide
RASQDLRNYLG

SEQ ID NO: 659 - protein, 11 aa, Artificial Sequence
  Description of Artificial Sequence: Synthetic peptide
RASQDLRNYLG

SEQ ID NO: 660 - protein, 11 aa, Artificial Sequence
  Description of Artificial Sequence: Synthetic peptide
RASQDLRNYLG

SEQ ID NO: 661 - protein, 11 aa, Artificial Sequence
  Description of Artificial Sequence: Synthetic peptide
RASQDLRNYLG

SEQ ID NO: 662 - protein, 11 aa, Artificial Sequence
  Description of Artificial Sequence: Synthetic peptide
RASQDLRNYLG

SEQ ID NO: 663 - protein, 11 aa, Artificial Sequence
  Description of Artificial Sequence: Synthetic peptide
RASQDLRNYLG

SEQ ID NO: 664 - protein, 11 aa, Artificial Sequence
  Description of Artificial Sequence: Synthetic peptide
RASQDLRNYLG

SEQ ID NO: 665 - protein, 11 aa, Artificial Sequence
  Description of Artificial Sequence: Synthetic peptide
RASQDLRNYLG

SEQ ID NO: 666 - protein, 11 aa, Artificial Sequence
  Description of Artificial Sequence: Synthetic peptide
RASQDLRNYLG

SEQ ID NO: 667 - protein, 11 aa, Artificial Sequence
  Description of Artificial Sequence: Synthetic peptide
RASQDLRNYLG

SEQ ID NO: 668 - protein, 11 aa, Artificial Sequence
  Description of Artificial Sequence: Synthetic peptide
QASQDISNYLN

SEQ ID NO: 669 - protein, 11 aa, Artificial Sequence
  Description of Artificial Sequence: Synthetic peptide
QASQDISNYLN

SEQ ID NO: 670 - protein, 11 aa, Artificial Sequence
  Description of Artificial Sequence: Synthetic peptide
QASQDISNYLN

SEQ ID NO: 671 - protein, 11 aa, Artificial Sequence
  Description of Artificial Sequence: Synthetic peptide
QASQDISNYLN

SEQ ID NO: 672 - protein, 11 aa, Artificial Sequence
  Description of Artificial Sequence: Synthetic peptide
QASQDISNYLN

SEQ ID NO: 673 - protein, 11 aa, Artificial Sequence
  Description of Artificial Sequence: Synthetic peptide
QASQDISNYLN

SEQ ID NO: 674 - protein, 11 aa, Artificial Sequence
  Description of Artificial Sequence: Synthetic peptide
QASQDISNYLN

SEQ ID NO: 675 - protein, 11 aa, Artificial Sequence
  Description of Artificial Sequence: Synthetic peptide
QASQDISNYLN

SEQ ID NO: 676 - protein, 11 aa, Artificial Sequence
  Description of Artificial Sequence: Synthetic peptide
QASQDISNYLN

SEQ ID NO: 677 - protein, 11 aa, Artificial Sequence
  Description of Artificial Sequence: Synthetic peptide
RASQDIRDYLG

SEQ ID NO: 678 - protein, 11 aa, Artificial Sequence
  Description of Artificial Sequence: Synthetic peptide
RASQDIRDYLG

SEQ ID NO: 679 - protein, 11 aa, Artificial Sequence
  Description of Artificial Sequence: Synthetic peptide
RASQDIRDYLG

SEQ ID NO: 680 - protein, 11 aa, Artificial Sequence
  Description of Artificial Sequence: Synthetic peptide
RASQDIRDYLG

SEQ ID NO: 681 - protein, 11 aa, Artificial Sequence
  Description of Artificial Sequence: Synthetic peptide
RASQDIRDYLG

SEQ ID NO: 682 - protein, 11 aa, Artificial Sequence
  Description of Artificial Sequence: Synthetic peptide
RASQDIRDYLG

SEQ ID NO: 683 - protein, 11 aa, Artificial Sequence
  Description of Artificial Sequence: Synthetic peptide
RASQDIRDYLG

SEQ ID NO: 684 - protein, 11 aa, Artificial Sequence
  Description of Artificial Sequence: Synthetic peptide
QASQDITNYLN

SEQ ID NO: 685 - protein, 11 aa, Artificial Sequence
  Description of Artificial Sequence: Synthetic peptide
QASQDITNYLN

SEQ ID NO: 686 - protein, 11 aa, Artificial Sequence
  Description of Artificial Sequence: Synthetic peptide
QASQDITNYLN

SEQ ID NO: 687 - protein, 11 aa, Artificial Sequence
  Description of Artificial Sequence: Synthetic peptide
QASQDITNYLN

SEQ ID NO: 688 - protein, 11 aa, Artificial Sequence
  Description of Artificial Sequence: Synthetic peptide
QASQDITNYLN

SEQ ID NO: 689 - protein, 11 aa, Artificial Sequence
  Description of Artificial Sequence: Synthetic peptide
QASQDITNYLN

SEQ ID NO: 690 - protein, 11 aa, Artificial Sequence
  Description of Artificial Sequence: Synthetic peptide
QASQDITNYLN

SEQ ID NO: 691 - protein, 11 aa, Artificial Sequence
  Description of Artificial Sequence: Synthetic peptide
QASQDITNYLN

SEQ ID NO: 692 - protein, 11 aa, Artificial Sequence
  Description of Artificial Sequence: Synthetic peptide
QASQDITNYLN

SEQ ID NO: 693 - protein, 11 aa, Artificial Sequence
  Description of Artificial Sequence: Synthetic peptide
QASQDITNYLN

SEQ ID NO: 694 - protein, 11 aa, Artificial Sequence
  Description of Artificial Sequence: Synthetic peptide
QASQDITNYLN

SEQ ID NO: 695 - protein, 12 aa, Artificial Sequence
  Description of Artificial Sequence: Synthetic peptide
RASQIFTSTYLA

SEQ ID NO: 696 - protein, 12 aa, Artificial Sequence
  Description of Artificial Sequence: Synthetic peptide
RASQIFTSTYLA

SEQ ID NO: 697 - protein, 12 aa, Artificial Sequence
  Description of Artificial Sequence: Synthetic peptide
RASQIFTSTYLA

SEQ ID NO: 698 - protein, 12 aa, Artificial Sequence
  Description of Artificial Sequence: Synthetic peptide
RASQIFTSTYLA

SEQ ID NO: 699 - protein, 11 aa, Artificial Sequence
  Description of Artificial Sequence: Synthetic peptide
RASQSVSSNLA

SEQ ID NO: 700 - protein, 11 aa, Artificial Sequence
  Description of Artificial Sequence: Synthetic peptide
RASQSVSSNLA

SEQ ID NO: 701 - protein, 11 aa, Artificial Sequence
  Description of Artificial Sequence: Synthetic peptide
RASQSVSSNLA

SEQ ID NO: 702 - protein, 11 aa, Artificial Sequence
  Description of Artificial Sequence: Synthetic peptide
RASQSVSSNLA

SEQ ID NO: 703 - protein, 11 aa, Artificial Sequence
  Description of Artificial Sequence: Synthetic peptide
RASQSVSSNLA

SEQ ID NO: 704 - protein, 11 aa, Artificial Sequence
  Description of Artificial Sequence: Synthetic peptide
RASQSVSSNLA

SEQ ID NO: 705 - protein, 11 aa, Artificial Sequence
  Description of Artificial Sequence: Synthetic peptide
RASQSVSSNLA

SEQ ID NO: 706 - protein, 11 aa, Artificial Sequence
  Description of Artificial Sequence: Synthetic peptide
RASQSVSSNLA

SEQ ID NO: 707 - protein, 12 aa, Artificial Sequence
  Description of Artificial Sequence: Synthetic peptide
RASQSISYSYLA

SEQ ID NO: 708 - protein, 12 aa, Artificial Sequence
  Description of Artificial Sequence: Synthetic peptide
RASQSISYSYLA

SEQ ID NO: 709 - protein, 12 aa, Artificial Sequence
  Description of Artificial Sequence: Synthetic peptide
RASQSISYSYLA

SEQ ID NO: 710 - protein, 12 aa, Artificial Sequence
  Description of Artificial Sequence: Synthetic peptide
RASQSISYSYLA

SEQ ID NO: 711 - protein, 12 aa, Artificial Sequence
  Description of Artificial Sequence: Synthetic peptide
RASQSISYSYLA

SEQ ID NO: 712 - protein, 12 aa, Artificial Sequence
  Description of Artificial Sequence: Synthetic peptide
RASQSISYSYLA

SEQ ID NO: 713 - protein, 12 aa, Artificial Sequence
  Description of Artificial Sequence: Synthetic peptide
RASQSISYSYLA

SEQ ID NO: 714 - protein, 17 aa, Artificial Sequence
  Description of Artificial Sequence: Synthetic peptide
KSSQSVLSSSNNKNYIA

SEQ ID NO: 715 - protein, 17 aa, Artificial Sequence
  Description of Artificial Sequence: Synthetic peptide
KSSQSVLSSSNNKNYIA

SEQ ID NO: 716 - protein, 17 aa, Artificial Sequence
  Description of Artificial Sequence: Synthetic peptide
KSSQSVLSSSNNKNYIA

SEQ ID NO: 717 - protein, 17 aa, Artificial Sequence
  Description of Artificial Sequence: Synthetic peptide
KSSQSVLSSSNNKNYIA

SEQ ID NO: 718 - protein, 17 aa, Artificial Sequence
  Description of Artificial Sequence: Synthetic peptide
KSSQSVLSSSNNKNYIA

SEQ ID NO: 719 - protein, 17 aa, Artificial Sequence
  Description of Artificial Sequence: Synthetic peptide
KSSQSVLSSSNNKNYIA

SEQ ID NO: 720 - protein, 17 aa, Artificial Sequence
  Description of Artificial Sequence: Synthetic peptide
KSSQSVLSSSNNKNYIA

SEQ ID NO: 721 - protein, 17 aa, Artificial Sequence
  Description of Artificial Sequence: Synthetic peptide
KSSQSVLSSSNNKNYIA

SEQ ID NO: 722 - protein, 17 aa, Artificial Sequence
  Description of Artificial Sequence: Synthetic peptide
KSSQSVLSSSNNKNYIA

SEQ ID NO: 723 - protein, 17 aa, Artificial Sequence
  Description of Artificial Sequence: Synthetic peptide
KSSQSVLSSSNNKNYIA

SEQ ID NO: 724 - protein, 17 aa, Artificial Sequence
  Description of Artificial Sequence: Synthetic peptide
KSSQSVLSSSNNKNYIA

SEQ ID NO: 725 - protein, 17 aa, Artificial Sequence
  Description of Artificial Sequence: Synthetic peptide
KSSQSVLSSSNNKNYLA

SEQ ID NO: 726 - protein, 17 aa, Artificial Sequence
  Description of Artificial Sequence: Synthetic peptide
KSSQSVLSSSNNKNYLA

SEQ ID NO: 727 - protein, 17 aa, Artificial Sequence
  Description of Artificial Sequence: Synthetic peptide
KSSQSVLSSSNNKNYLA

SEQ ID NO: 728 - protein, 17 aa, Artificial Sequence
  Description of Artificial Sequence: Synthetic peptide
KSSQSVLSSSNNKNYLA

SEQ ID NO: 729 - protein, 17 aa, Artificial Sequence
  Description of Artificial Sequence: Synthetic peptide
KSSQSVLSSSNNKNYLA

SEQ ID NO: 730 - protein, 17 aa, Artificial Sequence
  Description of Artificial Sequence: Synthetic peptide
KSSQSVLSSSNNKNYLA

SEQ ID NO: 731 - protein, 17 aa, Artificial Sequence
  Description of Artificial Sequence: Synthetic peptide
KSSQSVLSSSNNKNYLA

SEQ ID NO: 732 - protein, 17 aa, Artificial Sequence
  Description of Artificial Sequence: Synthetic peptide
KSSQSVLSSSNNKNYLA

SEQ ID NO: 733 - protein, 17 aa, Artificial Sequence
  Description of Artificial Sequence: Synthetic peptide
KSSQSVLSSSNNKNYLA

SEQ ID NO: 734 - protein, 17 aa, Artificial Sequence
  Description of Artificial Sequence: Synthetic peptide
KSSQSVLSSSNNKNYIA

SEQ ID NO: 735 - protein, 17 aa, Artificial Sequence
  Description of Artificial Sequence: Synthetic peptide
KSSQSVLSSSNNKNYIA

SEQ ID NO: 736 - protein, 17 aa, Artificial Sequence
  Description of Artificial Sequence: Synthetic peptide
KSSQSVLSSSNNKNYIA

SEQ ID NO: 737 - protein, 17 aa, Artificial Sequence
  Description of Artificial Sequence: Synthetic peptide
KSSQSVLSSSNNKNYIA

SEQ ID NO: 738 - protein, 17 aa, Artificial Sequence
  Description of Artificial Sequence: Synthetic peptide
KSSQSVLSSSNNKNYIA

SEQ ID NO: 739 - protein, 17 aa, Artificial Sequence
  Description of Artificial Sequence: Synthetic peptide
KSSQSVLSSSNNKNYLA

SEQ ID NO: 740 - protein, 17 aa, Artificial Sequence
  Description of Artificial Sequence: Synthetic peptide
KSSQSVLSSSNNKNYLA

SEQ ID NO: 741 - protein, 17 aa, Artificial Sequence
  Description of Artificial Sequence: Synthetic peptide
KSSQSVLSSSNNKNYLA

SEQ ID NO: 742 - protein, 17 aa, Artificial Sequence
  Description of Artificial Sequence: Synthetic peptide
KSSQSVLSSSNNKNYLA

SEQ ID NO: 743 - protein, 17 aa, Artificial Sequence
  Description of Artificial Sequence: Synthetic peptide
KSSQSVLSSSNNKNYLA

SEQ ID NO: 744 - protein, 17 aa, Artificial Sequence
  Description of Artificial Sequence: Synthetic peptide
KSSQSVLSSSNNKNYLA

SEQ ID NO: 745 - protein, 17 aa, Artificial Sequence
  Description of Artificial Sequence: Synthetic peptide
KSSQSVLSSSNNKNYLA

SEQ ID NO: 746 - protein, 17 aa, Artificial Sequence
  Description of Artificial Sequence: Synthetic peptide
KSSQSVLSSSNNKNYLA

SEQ ID NO: 747 - protein, 17 aa, Artificial Sequence
  Description of Artificial Sequence: Synthetic peptide
KSSQSVLSSSNNKNYLA

SEQ ID NO: 748 - protein, 17 aa, Artificial Sequence
  Description of Artificial Sequence: Synthetic peptide
KSSQSVLSSSNNKNYLA

SEQ ID NO: 749 - protein, 17 aa, Artificial Sequence
  Description of Artificial Sequence: Synthetic peptide
KSSQSVLSSSNNKNYLA

SEQ ID NO: 750 - protein, 17 aa, Artificial Sequence
  Description of Artificial Sequence: Synthetic peptide
KSSQSVLSSSNNKNYLA

SEQ ID NO: 751 - protein, 17 aa, Artificial Sequence
  Description of Artificial Sequence: Synthetic peptide
KSSQSVLSSSNNKNYLA

SEQ ID NO: 752 - protein, 13 aa, Artificial Sequence
  Description of Artificial Sequence: Synthetic peptide
SGSSSNIGSQTVN

SEQ ID NO: 753 - protein, 13 aa, Artificial Sequence
  Description of Artificial Sequence: Synthetic peptide
SGSSSNIGSQTVN

SEQ ID NO: 754 - protein, 13 aa, Artificial Sequence
  Description of Artificial Sequence: Synthetic peptide
SGSSSNIGSNYVN

SEQ ID NO: 755 - protein, 13 aa, Artificial Sequence
  Description of Artificial Sequence: Synthetic peptide
SGSSSNIGSNYVN

SEQ ID NO: 756 - protein, 13 aa, Artificial Sequence
  Description of Artificial Sequence: Synthetic peptide
SGSSSNIGSQTVN

SEQ ID NO: 757 - protein, 13 aa, Artificial Sequence
  Description of Artificial Sequence: Synthetic peptide
SGSSSNIGSNYVN

SEQ ID NO: 758 - protein, 13 aa, Artificial Sequence
  Description of Artificial Sequence: Synthetic peptide
SGSSSNIGSNTVN

SEQ ID NO: 759 - protein, 13 aa, Artificial Sequence
  Description of Artificial Sequence: Synthetic peptide
SGSSSNIGSNTVN

SEQ ID NO: 760 - protein, 13 aa, Artificial Sequence
  Description of Artificial Sequence: Synthetic peptide
SGSSSNIGSNTVN

SEQ ID NO: 761 - protein, 13 aa, Artificial Sequence
  Description of Artificial Sequence: Synthetic peptide
SGSSSNIGSNTVN

SEQ ID NO: 762 - protein, 13 aa, Artificial Sequence
  Description of Artificial Sequence: Synthetic peptide
SGSSSNIGSNTVN

SEQ ID NO: 763 - protein, 13 aa, Artificial Sequence
  Description of Artificial Sequence: Synthetic peptide
SGSSSNIGSNYVN

SEQ ID NO: 764 - protein, 13 aa, Artificial Sequence
  Description of Artificial Sequence: Synthetic peptide
SGSSSNIGSNYVN

SEQ ID NO: 765 - protein, 13 aa, Artificial Sequence
  Description of Artificial Sequence: Synthetic peptide
SGSSSNIGSQTVN

SEQ ID NO: 766 - protein, 11 aa, Artificial Sequence
  Description of Artificial Sequence: Synthetic peptide
RASQDLRNYLG

SEQ ID NO: 767 - protein, 11 aa, Artificial Sequence
  Description of Artificial Sequence: Synthetic peptide
RASQDIRDYLG

SEQ ID NO: 768 - protein, 13 aa, Artificial Sequence
  Description of Artificial Sequence: Synthetic peptide
SGSSSNIGSNTVN

SEQ ID NO: 769 - protein, 11 aa, Artificial Sequence
  Description of Artificial Sequence: Synthetic peptide
RASQTISRFLN

SEQ ID NO: 770 - protein, 13 aa, Artificial Sequence
  Description of Artificial Sequence: Synthetic peptide
SGSSSNIGNNYVS

SEQ ID NO: 771 - protein, 11 aa, Artificial Sequence
  Description of Artificial Sequence: Synthetic peptide
RASQTISRFLN

SEQ ID NO: 772 - protein, 11 aa, Artificial Sequence
  Description of Artificial Sequence: Synthetic peptide
RASQTISRFLN

SEQ ID NO: 773 - protein, 11 aa, Artificial Sequence
  Description of Artificial Sequence: Synthetic peptide
RASQTISRFLN

SEQ ID NO: 774 - protein, 11 aa, Artificial Sequence
  Description of Artificial Sequence: Synthetic peptide
RASQTISRFLN

SEQ ID NO: 775 - protein, 11 aa, Artificial Sequence
  Description of Artificial Sequence: Synthetic peptide
RASQTISRFLN

SEQ ID NO: 776 - protein, 11 aa, Artificial Sequence
  Description of Artificial Sequence: Synthetic peptide
RASQTISRFLN

SEQ ID NO: 777 - protein, 13 aa, Artificial Sequence
  Description of Artificial Sequence: Synthetic peptide
SGSSSNIGNNYVS

SEQ ID NO: 778 - protein, 13 aa, Artificial Sequence
  Description of Artificial Sequence: Synthetic peptide
SGSSSNIGNNYVS

SEQ ID NO: 779 - protein, 13 aa, Artificial Sequence
  Description of Artificial Sequence: Synthetic peptide
SGSSSNIGNNYVS

SEQ ID NO: 780 - protein, 13 aa, Artificial Sequence
  Description of Artificial Sequence: Synthetic peptide
SGSSSNIGNNYVS

SEQ ID NO: 781 - protein, 13 aa, Artificial Sequence
  Description of Artificial Sequence: Synthetic peptide
SGSSSNIGNNYVS

SEQ ID NO: 782 - protein, 13 aa, Artificial Sequence
  Description of Artificial Sequence: Synthetic peptide
SGSSSNIGNNYVS

SEQ ID NO: 783 - protein, 13 aa, Artificial Sequence
  Description of Artificial Sequence: Synthetic peptide
SGSSSNIGNNYVS

SEQ ID NO: 784 - protein, 13 aa, Artificial Sequence
  Description of Artificial Sequence: Synthetic peptide
SGSSSNIGNNYVS

SEQ ID NO: 785 - protein, 11 aa, Artificial Sequence
  Description of Artificial Sequence: Synthetic peptide
RASQTISRFLN

SEQ ID NO: 786 - protein, 7 aa, Artificial Sequence
  Description of Artificial Sequence: Synthetic peptide
TNNQRPS

SEQ ID NO: 787 - protein, 7 aa, Artificial Sequence
  Description of Artificial Sequence: Synthetic peptide
GASSLQS

SEQ ID NO: 788 - protein, 7 aa, Artificial Sequence
  Description of Artificial Sequence: Synthetic peptide
GASSLQS

SEQ ID NO: 789 - protein, 7 aa, Artificial Sequence
  Description of Artificial Sequence: Synthetic peptide
DASNLET

SEQ ID NO: 790 - protein, 7 aa, Artificial Sequence
  Description of Artificial Sequence: Synthetic peptide
WASTRES

SEQ ID NO: 791 - protein, 7 aa, Artificial Sequence
  Description of Artificial Sequence: Synthetic peptide
WASTRES

SEQ ID NO: 792 - protein, 7 aa, Artificial Sequence
  Description of Artificial Sequence: Synthetic peptide
WTSTRDS

SEQ ID NO: 793 - protein, 7 aa, Artificial Sequence
  Description of Artificial Sequence: Synthetic peptide
WTSTRDS

SEQ ID NO: 794 - protein, 7 aa, Artificial Sequence
  Description of Artificial Sequence: Synthetic peptide
GASSRAT

SEQ ID NO: 795 - protein, 7 aa, Artificial Sequence
  Description of Artificial Sequence: Synthetic peptide
GAATRAT

SEQ ID NO: 796 - protein, 7 aa, Artificial Sequence
  Description of Artificial Sequence: Synthetic peptide
GASSLQS

SEQ ID NO: 797 - protein, 7 aa, Artificial Sequence
  Description of Artificial Sequence: Synthetic peptide
DASNLEP

SEQ ID NO: 798 - protein, 7 aa, Artificial Sequence
  Description of Artificial Sequence: Synthetic peptide
AASSLQS

SEQ ID NO: 799 - protein, 7 aa, Artificial Sequence
  Description of Artificial Sequence: Synthetic peptide
AASSLQS

SEQ ID NO: 800 - protein, 7 aa, Artificial Sequence
  Description of Artificial Sequence: Synthetic peptide
GASSLQS

SEQ ID NO: 801 - protein, 7 aa, Artificial Sequence
  Description of Artificial Sequence: Synthetic peptide
GASSLQS

SEQ ID NO: 802 - protein, 7 aa, Artificial Sequence
  Description of Artificial Sequence: Synthetic peptide
GASSLQS

SEQ ID NO: 803 - protein, 7 aa, Artificial Sequence
  Description of Artificial Sequence: Synthetic peptide
GASSLQS

SEQ ID NO: 804 - protein, 7 aa, Artificial Sequence
  Description of Artificial Sequence: Synthetic peptide
GASSLQS

SEQ ID NO: 805 - protein, 7 aa, Artificial Sequence
  Description of Artificial Sequence: Synthetic peptide
GASSLQS

SEQ ID NO: 806 - protein, 7 aa, Artificial Sequence
  Description of Artificial Sequence: Synthetic peptide
GASSLQS

SEQ ID NO: 807 - protein, 7 aa, Artificial Sequence
  Description of Artificial Sequence: Synthetic peptide
GASSLQS

SEQ ID NO: 808 - protein, 7 aa, Artificial Sequence
  Description of Artificial Sequence: Synthetic peptide
GASSLQS

SEQ ID NO: 809 - protein, 7 aa, Artificial Sequence
  Description of Artificial Sequence: Synthetic peptide
GASSLQS

SEQ ID NO: 810 - protein, 7 aa, Artificial Sequence
  Description of Artificial Sequence: Synthetic peptide
GASSLQS

SEQ ID NO: 811 - protein, 7 aa, Artificial Sequence
  Description of Artificial Sequence: Synthetic peptide
GASSLQS

SEQ ID NO: 812 - protein, 7 aa, Artificial Sequence
  Description of Artificial Sequence: Synthetic peptide
GASSLQS

SEQ ID NO: 813 - protein, 7 aa, Artificial Sequence
  Description of Artificial Sequence: Synthetic peptide
GASSLQS

SEQ ID NO: 814 - protein, 7 aa, Artificial Sequence
  Description of Artificial Sequence: Synthetic peptide
GASSLQS

SEQ ID NO: 815 - protein, 7 aa, Artificial Sequence
  Description of Artificial Sequence: Synthetic peptide
GASSLQS

SEQ ID NO: 816 - protein, 7 aa, Artificial Sequence
  Description of Artificial Sequence: Synthetic peptide
GASSLQS

SEQ ID NO: 817 - protein, 7 aa, Artificial Sequence
  Description of Artificial Sequence: Synthetic peptide
GASSLQS

SEQ ID NO: 818 - protein, 7 aa, Artificial Sequence
  Description of Artificial Sequence: Synthetic peptide
GASSLQS

SEQ ID NO: 819 - protein, 7 aa, Artificial Sequence
  Description of Artificial Sequence: Synthetic peptide
GASSLQS

SEQ ID NO: 820 - protein, 7 aa, Artificial Sequence
  Description of Artificial Sequence: Synthetic peptide
GASSLQS

SEQ ID NO: 821 - protein, 7 aa, Artificial Sequence
  Description of Artificial Sequence: Synthetic peptide
GASSLQS

SEQ ID NO: 822 - protein, 7 aa, Artificial Sequence
  Description of Artificial Sequence: Synthetic peptide
GASSLQS

SEQ ID NO: 823 - protein, 7 aa, Artificial Sequence
  Description of Artificial Sequence: Synthetic peptide
GASSLQS

SEQ ID NO: 824 - protein, 7 aa, Artificial Sequence
  Description of Artificial Sequence: Synthetic peptide
GASSLQS

SEQ ID NO: 825 - protein, 7 aa, Artificial Sequence
  Description of Artificial Sequence: Synthetic peptide
DASNLET

SEQ ID NO: 826 - protein, 7 aa, Artificial Sequence
  Description of Artificial Sequence: Synthetic peptide
DASNLET

SEQ ID NO: 827 - protein, 7 aa, Artificial Sequence
  Description of Artificial Sequence: Synthetic peptide
DASNLET

SEQ ID NO: 828 - protein, 7 aa, Artificial Sequence
  Description of Artificial Sequence: Synthetic peptide
DASNLET

SEQ ID NO: 829 - protein, 7 aa, Artificial Sequence
  Description of Artificial Sequence: Synthetic peptide
DASNLET

SEQ ID NO: 830 - protein, 7 aa, Artificial Sequence
  Description of Artificial Sequence: Synthetic peptide
DASNLET

SEQ ID NO: 831 - protein, 7 aa, Artificial Sequence
  Description of Artificial Sequence: Synthetic peptide
DASNLET

SEQ ID NO: 832 - protein, 7 aa, Artificial Sequence
  Description of Artificial Sequence: Synthetic peptide
DASNLET

SEQ ID NO: 833 - protein, 7 aa, Artificial Sequence
  Description of Artificial Sequence: Synthetic peptide
DASNLET

SEQ ID NO: 834 - protein, 7 aa, Artificial Sequence
  Description of Artificial Sequence: Synthetic peptide
GASSLQS

SEQ ID NO: 835 - protein, 7 aa, Artificial Sequence
  Description of Artificial Sequence: Synthetic peptide
GASSLQS

SEQ ID NO: 836 - protein, 7 aa, Artificial Sequence
  Description of Artificial Sequence: Synthetic peptide
GASSLQS

SEQ ID NO: 837 - protein, 7 aa, Artificial Sequence
  Description of Artificial Sequence: Synthetic peptide
GASSLQS

SEQ ID NO: 838 - protein, 7 aa, Artificial Sequence
  Description of Artificial Sequence: Synthetic peptide
GASSLQS

SEQ ID NO: 839 - protein, 7 aa, Artificial Sequence
  Description of Artificial Sequence: Synthetic peptide
GASSLQS

SEQ ID NO: 840 - protein, 7 aa, Artificial Sequence
  Description of Artificial Sequence: Synthetic peptide
GASSLQS

SEQ ID NO: 841 - protein, 7 aa, Artificial Sequence
  Description of Artificial Sequence: Synthetic peptide
DASNLEP

SEQ ID NO: 842 - protein, 7 aa, Artificial Sequence
  Description of Artificial Sequence: Synthetic peptide
DASNLEP

SEQ ID NO: 843 - protein, 7 aa, Artificial Sequence
  Description of Artificial Sequence: Synthetic peptide
DASNLEP

SEQ ID NO: 844 - protein, 7 aa, Artificial Sequence
  Description of Artificial Sequence: Synthetic peptide
DASNLEP

SEQ ID NO: 845 - protein, 7 aa, Artificial Sequence
  Description of Artificial Sequence: Synthetic peptide
DASNLEP

SEQ ID NO: 846 - protein, 7 aa, Artificial Sequence
  Description of Artificial Sequence: Synthetic peptide
DASNLEP

SEQ ID NO: 847 - protein, 7 aa, Artificial Sequence
  Description of Artificial Sequence: Synthetic peptide
DASNLEP

SEQ ID NO: 848 - protein, 7 aa, Artificial Sequence
  Description of Artificial Sequence: Synthetic peptide
DASNLEP

SEQ ID NO: 849 - protein, 7 aa, Artificial Sequence
  Description of Artificial Sequence: Synthetic peptide
DASNLEP

SEQ ID NO: 850 - protein, 7 aa, Artificial Sequence
  Description of Artificial Sequence: Synthetic peptide
DASNLEP

SEQ ID NO: 851 - protein, 7 aa, Artificial Sequence
  Description of Artificial Sequence: Synthetic peptide
DASNLEP

SEQ ID NO: 852 - protein, 7 aa, Artificial Sequence
  Description of Artificial Sequence: Synthetic peptide
GASSRAT

SEQ ID NO: 853 - protein, 7 aa, Artificial Sequence
  Description of Artificial Sequence: Synthetic peptide
GASSRAT

SEQ ID NO: 854 - protein, 7 aa, Artificial Sequence
  Description of Artificial Sequence: Synthetic peptide
GASSRAT

SEQ ID NO: 855 - protein, 7 aa, Artificial Sequence
  Description of Artificial Sequence: Synthetic peptide
GASSRAT

SEQ ID NO: 856 - protein, 7 aa, Artificial Sequence
  Description of Artificial Sequence: Synthetic peptide
GAATRAT

SEQ ID NO: 857 - protein, 7 aa, Artificial Sequence
  Description of Artificial Sequence: Synthetic peptide
GAATRAT

SEQ ID NO: 858 - protein, 7 aa, Artificial Sequence
  Description of Artificial Sequence: Synthetic peptide
GAATRAT

SEQ ID NO: 859 - protein, 7 aa, Artificial Sequence
  Description of Artificial Sequence: Synthetic peptide
GAATRAT

SEQ ID NO: 860 - protein, 7 aa, Artificial Sequence
  Description of Artificial Sequence: Synthetic peptide
GAATRAT

SEQ ID NO: 861 - protein, 7 aa, Artificial Sequence
  Description of Artificial Sequence: Synthetic peptide
GAATRAT

SEQ ID NO: 862 - protein, 7 aa, Artificial Sequence
  Description of Artificial Sequence: Synthetic peptide
GAATRAT

SEQ ID NO: 863 - protein, 7 aa, Artificial Sequence
  Description of Artificial Sequence: Synthetic peptide
GAATRAT

SEQ ID NO: 864 - protein, 7 aa, Artificial Sequence
  Description of Artificial Sequence: Synthetic peptide
GASSRAT

SEQ ID NO: 865 - protein, 7 aa, Artificial Sequence
  Description of Artificial Sequence: Synthetic peptide
GASSRAT

SEQ ID NO: 866 - protein, 7 aa, Artificial Sequence
  Description of Artificial Sequence: Synthetic peptide
GASSRAT

SEQ ID NO: 867 - protein, 7 aa, Artificial Sequence
  Description of Artificial Sequence: Synthetic peptide
GASSRAT

SEQ ID NO: 868 - protein, 7 aa, Artificial Sequence
  Description of Artificial Sequence: Synthetic peptide
GASSRAT

SEQ ID NO: 869 - protein, 7 aa, Artificial Sequence
  Description of Artificial Sequence: Synthetic peptide
GASSRAT

SEQ ID NO: 870 - protein, 7 aa, Artificial Sequence
  Description of Artificial Sequence: Synthetic peptide
GASSRAT

SEQ ID NO: 871 - protein, 7 aa, Artificial Sequence
  Description of Artificial Sequence: Synthetic peptide
WASTRES

SEQ ID NO: 872 - protein, 7 aa, Artificial Sequence
  Description of Artificial Sequence: Synthetic peptide
WASTRES

SEQ ID NO: 873 - protein, 7 aa, Artificial Sequence
  Description of Artificial Sequence: Synthetic peptide
WASTRES

SEQ ID NO: 874 - protein, 7 aa, Artificial Sequence
  Description of Artificial Sequence: Synthetic peptide
WASTRES

SEQ ID NO: 875 - protein, 7 aa, Artificial Sequence
  Description of Artificial Sequence: Synthetic peptide
WASTRES

SEQ ID NO: 876 - protein, 7 aa, Artificial Sequence
  Description of Artificial Sequence: Synthetic peptide
WASTRES

SEQ ID NO: 877 - protein, 7 aa, Artificial Sequence
  Description of Artificial Sequence: Synthetic peptide
WASTRES

SEQ ID NO: 878 - protein, 7 aa, Artificial Sequence
  Description of Artificial Sequence: Synthetic peptide
WASTRES

SEQ ID NO: 879 - protein, 7 aa, Artificial Sequence
  Description of Artificial Sequence: Synthetic peptide
WASTRES

SEQ ID NO: 880 - protein, 7 aa, Artificial Sequence
  Description of Artificial Sequence: Synthetic peptide
WASTRES

SEQ ID NO: 881 - protein, 7 aa, Artificial Sequence
  Description of Artificial Sequence: Synthetic peptide
WASTRES

SEQ ID NO: 882 - protein, 7 aa, Artificial Sequence
  Description of Artificial Sequence: Synthetic peptide
WTSTRES

SEQ ID NO: 883 - protein, 7 aa, Artificial Sequence
  Description of Artificial Sequence: Synthetic peptide
WTSTRES

SEQ ID NO: 884 - protein, 7 aa, Artificial Sequence
  Description of Artificial Sequence: Synthetic peptide
WTSTRDS

SEQ ID NO: 885 - protein, 7 aa, Artificial Sequence
  Description of Artificial Sequence: Synthetic peptide
WTSTRES

SEQ ID NO: 886 - protein, 7 aa, Artificial Sequence
  Description of Artificial Sequence: Synthetic peptide
WTSTRES

SEQ ID NO: 887 - protein, 7 aa, Artificial Sequence
  Description of Artificial Sequence: Synthetic peptide
WTSTRDS

SEQ ID NO: 888 - protein, 7 aa, Artificial Sequence
  Description of Artificial Sequence: Synthetic peptide
WTSTRDS

SEQ ID NO: 889 - protein, 7 aa, Artificial Sequence
  Description of Artificial Sequence: Synthetic peptide
WTSTRES

SEQ ID NO: 890 - protein, 7 aa, Artificial Sequence
  Description of Artificial Sequence: Synthetic peptide
WTSTRES

SEQ ID NO: 891 - protein, 7 aa, Artificial Sequence
  Description of Artificial Sequence: Synthetic peptide
WASTRES

SEQ ID NO: 892 - protein, 7 aa, Artificial Sequence
  Description of Artificial Sequence: Synthetic peptide
WASTRES

SEQ ID NO: 893 - protein, 7 aa, Artificial Sequence
  Description of Artificial Sequence: Synthetic peptide
WASTRES

SEQ ID NO: 894 - protein, 7 aa, Artificial Sequence
  Description of Artificial Sequence: Synthetic peptide
WASTRES

SEQ ID NO: 895 - protein, 7 aa, Artificial Sequence
  Description of Artificial Sequence: Synthetic peptide
WASTRES

SEQ ID NO: 896 - protein, 7 aa, Artificial Sequence
  Description of Artificial Sequence: Synthetic peptide
WTSTRDS

SEQ ID NO: 897 - protein, 7 aa, Artificial Sequence
  Description of Artificial Sequence: Synthetic peptide
WTSTRDS

SEQ ID NO: 898 - protein, 7 aa, Artificial Sequence
  Description of Artificial Sequence: Synthetic peptide
WTSTRDS

SEQ ID NO: 899 - protein, 7 aa, Artificial Sequence
  Description of Artificial Sequence: Synthetic peptide
WTSTRDS

SEQ ID NO: 900 - protein, 7 aa, Artificial Sequence
  Description of Artificial Sequence: Synthetic peptide
WTSTRDS

SEQ ID NO: 901 - protein, 7 aa, Artificial Sequence
  Description of Artificial Sequence: Synthetic peptide
WTSTRDS

SEQ ID NO: 902 - protein, 7 aa, Artificial Sequence
  Description of Artificial Sequence: Synthetic peptide
WTSTRDS

SEQ ID NO: 903 - protein, 7 aa, Artificial Sequence
  Description of Artificial Sequence: Synthetic peptide
WTSTRES

SEQ ID NO: 904 - protein, 7 aa, Artificial Sequence
  Description of Artificial Sequence: Synthetic peptide
WTSTRES

SEQ ID NO: 905 - protein, 7 aa, Artificial Sequence
  Description of Artificial Sequence: Synthetic peptide
WTSTRES

SEQ ID NO: 906 - protein, 7 aa, Artificial Sequence
  Description of Artificial Sequence: Synthetic peptide
WTSTRES

SEQ ID NO: 907 - protein, 7 aa, Artificial Sequence
  Description of Artificial Sequence: Synthetic peptide
WTSTRDS

SEQ ID NO: 908 - protein, 7 aa, Artificial Sequence
  Description of Artificial Sequence: Synthetic peptide
WTSTRES

SEQ ID NO: 909 - protein, 7 aa, Artificial Sequence
  Description of Artificial Sequence: Synthetic peptide
TNNQRPS

SEQ ID NO: 910 - protein, 7 aa, Artificial Sequence
  Description of Artificial Sequence: Synthetic peptide
TNNQRPS

SEQ ID NO: 911 - protein, 7 aa, Artificial Sequence
  Description of Artificial Sequence: Synthetic peptide
TNNQRPS

SEQ ID NO: 912 - protein, 7 aa, Artificial Sequence
  Description of Artificial Sequence: Synthetic peptide
TNNQRPS

SEQ ID NO: 913 - protein, 7 aa, Artificial Sequence
  Description of Artificial Sequence: Synthetic peptide
TNNQRPS

SEQ ID NO: 914 - protein, 7 aa, Artificial Sequence
  Description of Artificial Sequence: Synthetic peptide
TNNQRPS

SEQ ID NO: 915 - protein, 7 aa, Artificial Sequence
  Description of Artificial Sequence: Synthetic peptide
TNNQRPS

SEQ ID NO: 916 - protein, 7 aa, Artificial Sequence
  Description of Artificial Sequence: Synthetic peptide
TNNQRPS

SEQ ID NO: 917 - protein, 7 aa, Artificial Sequence
  Description of Artificial Sequence: Synthetic peptide
TNNQRPS

SEQ ID NO: 918 - protein, 7 aa, Artificial Sequence
  Description of Artificial Sequence: Synthetic peptide
TNNQRPS

SEQ ID NO: 919 - protein, 7 aa, Artificial Sequence
  Description of Artificial Sequence: Synthetic peptide
TNNQRPS

SEQ ID NO: 920 - protein, 7 aa, Artificial Sequence
  Description of Artificial Sequence: Synthetic peptide
TNNQRPS

SEQ ID NO: 921 - protein, 7 aa, Artificial Sequence
  Description of Artificial Sequence: Synthetic peptide
TNNQRPS

SEQ ID NO: 922 - protein, 7 aa, Artificial Sequence
  Description of Artificial Sequence: Synthetic peptide
TNNQRPS

SEQ ID NO: 923 - protein, 7 aa, Artificial Sequence
  Description of Artificial Sequence: Synthetic peptide
GASSLQS

SEQ ID NO: 924 - protein, 7 aa, Artificial Sequence
  Description of Artificial Sequence: Synthetic peptide
GASSLQS

SEQ ID NO: 925 - protein, 7 aa, Artificial Sequence
  Description of Artificial Sequence: Synthetic peptide
TNNQRPS

SEQ ID NO: 926 - protein, 7 aa, Artificial Sequence
  Description of Artificial Sequence: Synthetic peptide
VASSLQS

SEQ ID NO: 927 - protein, 7 aa, Artificial Sequence
  Description of Artificial Sequence: Synthetic peptide
DNNKRPS

SEQ ID NO: 928 - protein, 7 aa, Artificial Sequence
  Description of Artificial Sequence: Synthetic peptide
VASSLQS

SEQ ID NO: 929 - protein, 7 aa, Artificial Sequence
  Description of Artificial Sequence: Synthetic peptide
VASSLQS

SEQ ID NO: 930 - protein, 7 aa, Artificial Sequence
  Description of Artificial Sequence: Synthetic peptide
VASSLQS

SEQ ID NO: 931 - protein, 7 aa, Artificial Sequence
  Description of Artificial Sequence: Synthetic peptide
VASSLQS

SEQ ID NO: 932 - protein, 7 aa, Artificial Sequence
  Description of Artificial Sequence: Synthetic peptide
VASSLQS

SEQ ID NO: 933 - protein, 7 aa, Artificial Sequence
  Description of Artificial Sequence: Synthetic peptide
VASSLQS

SEQ ID NO: 934 - protein, 7 aa, Artificial Sequence
  Description of Artificial Sequence: Synthetic peptide
DNNKRPS

SEQ ID NO: 935 - protein, 7 aa, Artificial Sequence
  Description of Artificial Sequence: Synthetic peptide
DNNKRPS

SEQ ID NO: 936 - protein, 7 aa, Artificial Sequence
  Description of Artificial Sequence: Synthetic peptide
DNNKRPS

SEQ ID NO: 937 - protein, 7 aa, Artificial Sequence
  Description of Artificial Sequence: Synthetic peptide
DNNKRPS

SEQ ID NO: 938 - protein, 7 aa, Artificial Sequence
  Description of Artificial Sequence: Synthetic peptide
DNNKRPS

SEQ ID NO: 939 - protein, 7 aa, Artificial Sequence
  Description of Artificial Sequence: Synthetic peptide
DNNKRPS

SEQ ID NO: 940 - protein, 7 aa, Artificial Sequence
  Description of Artificial Sequence: Synthetic peptide
DNNKRPS

SEQ ID NO: 941 - protein, 7 aa, Artificial Sequence
  Description of Artificial Sequence: Synthetic peptide
DNNKRPS

SEQ ID NO: 942 - protein, 7 aa, Artificial Sequence
  Description of Artificial Sequence: Synthetic peptide
VASSLQS

SEQ ID NO: 943 - protein, 11 aa, Artificial Sequence
  Description of Artificial Sequence: Synthetic peptide
ATFDDSLNGPV

SEQ ID NO: 944 - protein, 9 aa, Artificial Sequence
  Description of Artificial Sequence: Synthetic peptide
LQHNNYPFT

SEQ ID NO: 945 - protein, 9 aa, Artificial Sequence
  Description of Artificial Sequence: Synthetic peptide
LQHNNYPFT

SEQ ID NO: 946 - protein, 8 aa, Artificial Sequence
  Description of Artificial Sequence: Synthetic peptide
QQYDILLT

SEQ ID NO: 947 - protein, 9 aa, Artificial Sequence
  Description of Artificial Sequence: Synthetic peptide
QQYYSTPWT

SEQ ID NO: 948 - protein, 9 aa, Artificial Sequence
  Description of Artificial Sequence: Synthetic peptide
QQYYSTPWT

SEQ ID NO: 949 - protein, 9 aa, Artificial Sequence
  Description of Artificial Sequence: Synthetic peptide
QQYYRTPWT

SEQ ID NO: 950 - protein, 9 aa, Artificial Sequence
  Description of Artificial Sequence: Synthetic peptide
QQYYRTPWT

SEQ ID NO: 951 - protein, 9 aa, Artificial Sequence
  Description of Artificial Sequence: Synthetic peptide
QQYGSSPLT

SEQ ID NO: 952 - protein, 9 aa, Artificial Sequence
  Description of Artificial Sequence: Synthetic peptide
QQYNNWPLT

SEQ ID NO: 953 - protein, 9 aa, Artificial Sequence
  Description of Artificial Sequence: Synthetic peptide
LQHNSYPFT

SEQ ID NO: 954 - protein, 8 aa, Artificial Sequence
  Description of Artificial Sequence: Synthetic peptide
QQYDDLFT

SEQ ID NO: 955 - protein, 9 aa, Artificial Sequence
  Description of Artificial Sequence: Synthetic peptide
QQTNSFPPT

SEQ ID NO: 956 - protein, 9 aa, Artificial Sequence
  Description of Artificial Sequence: Synthetic peptide
QQTNSFPPT

SEQ ID NO: 957 - protein, 9 aa, Artificial Sequence
  Description of Artificial Sequence: Synthetic peptide
LQHNSYPFT

SEQ ID NO: 958 - protein, 9 aa, Artificial Sequence
  Description of Artificial Sequence: Synthetic peptide
LQHNSYPFT

SEQ ID NO: 959 - protein, 9 aa, Artificial Sequence
  Description of Artificial Sequence: Synthetic peptide
LQHNSYPFT

SEQ ID NO: 960 - protein, 9 aa, Artificial Sequence
  Description of Artificial Sequence: Synthetic peptide
LQHNSYPFT

SEQ ID NO: 961 - protein, 9 aa, Artificial Sequence
  Description of Artificial Sequence: Synthetic peptide
LQHNSYPFT

SEQ ID NO: 962 - protein, 9 aa, Artificial Sequence
  Description of Artificial Sequence: Synthetic peptide
LQHNSYPFT

SEQ ID NO: 963 - protein, 9 aa, Artificial Sequence
  Description of Artificial Sequence: Synthetic peptide
LQHNNYPFT

SEQ ID NO: 964 - protein, 9 aa, Artificial Sequence
  Description of Artificial Sequence: Synthetic peptide
LQHNNYPFT

SEQ ID NO: 965 - protein, 9 aa, Artificial Sequence
  Description of Artificial Sequence: Synthetic peptide
LQHNNYPFT

SEQ ID NO: 966 - protein, 9 aa, Artificial Sequence
  Description of Artificial Sequence: Synthetic peptide
LQHNNYPFT

SEQ ID NO: 967 - protein, 9 aa, Artificial Sequence
  Description of Artificial Sequence: Synthetic peptide
LQHNNYPFT

SEQ ID NO: 968 - protein, 9 aa, Artificial Sequence
  Description of Artificial Sequence: Synthetic peptide
LQHNNYPFT

SEQ ID NO: 969 - protein, 9 aa, Artificial Sequence
  Description of Artificial Sequence: Synthetic peptide
LQHNNYPFT

SEQ ID NO: 970 - protein, 9 aa, Artificial Sequence
  Description of Artificial Sequence: Synthetic peptide
LQHNNYPFT

SEQ ID NO: 971 - protein, 9 aa, Artificial Sequence
  Description of Artificial Sequence: Synthetic peptide
LQHNNYPFT

SEQ ID NO: 972 - protein, 9 aa, Artificial Sequence
  Description of Artificial Sequence: Synthetic peptide
LQHNNYPFT

SEQ ID NO: 973 - protein, 9 aa, Artificial Sequence
  Description of Artificial Sequence: Synthetic peptide
LQHNNYPFT

SEQ ID NO: 974 - protein, 9 aa, Artificial Sequence
  Description of Artificial Sequence: Synthetic peptide
LQHNNYPFT

SEQ ID NO: 975 - protein, 9 aa, Artificial Sequence
  Description of Artificial Sequence: Synthetic peptide
LQHNNYPFT

SEQ ID NO: 976 - protein, 9 aa, Artificial Sequence
  Description of Artificial Sequence: Synthetic peptide
LQHNNYPFT

SEQ ID NO: 977 - protein, 9 aa, Artificial Sequence
  Description of Artificial Sequence: Synthetic peptide
LQHNNYPFT

SEQ ID NO: 978 - protein, 9 aa, Artificial Sequence
  Description of Artificial Sequence: Synthetic peptide
LQHNNYPFT

SEQ ID NO: 979 - protein, 9 aa, Artificial Sequence
  Description of Artificial Sequence: Synthetic peptide
LQHNNYPFT

SEQ ID NO: 980 - protein, 9 aa, Artificial Sequence
  Description of Artificial Sequence: Synthetic peptide
LQHNNYPFT

SEQ ID NO: 981 - protein, 9 aa, Artificial Sequence
  Description of Artificial Sequence: Synthetic peptide
LQHNNYPFT

SEQ ID NO: 982 - protein, 8 aa, Artificial Sequence
  Description of Artificial Sequence: Synthetic peptide
QQYDILLT

SEQ ID NO: 983 - protein, 8 aa, Artificial Sequence
  Description of Artificial Sequence: Synthetic peptide
QQYDILLT

SEQ ID NO: 984 - protein, 8 aa, Artificial Sequence
  Description of Artificial Sequence: Synthetic peptide
QQYDILLT

SEQ ID NO: 985 - protein, 8 aa, Artificial Sequence
  Description of Artificial Sequence: Synthetic peptide
QQYDILLT

SEQ ID NO: 986 - protein, 8 aa, Artificial Sequence
  Description of Artificial Sequence: Synthetic peptide
QQYDILLT

SEQ ID NO: 987 - protein, 8 aa, Artificial Sequence
  Description of Artificial Sequence: Synthetic peptide
QQYDILLT

SEQ ID NO: 988 - protein, 8 aa, Artificial Sequence
  Description of Artificial Sequence: Synthetic peptide
QQYDILLT

SEQ ID NO: 989 - protein, 8 aa, Artificial Sequence
  Description of Artificial Sequence: Synthetic peptide
QQYDILLT

SEQ ID NO: 990 - protein, 8 aa, Artificial Sequence
  Description of Artificial Sequence: Synthetic peptide
QQYDILLT

SEQ ID NO: 991 - protein, 9 aa, Artificial Sequence
  Description of Artificial Sequence: Synthetic peptide
LQHNNYPFT

SEQ ID NO: 992 - protein, 9 aa, Artificial Sequence
  Description of Artificial Sequence: Synthetic peptide
LQHNNYPFT

SEQ ID NO: 993 - protein, 9 aa, Artificial Sequence
  Description of Artificial Sequence: Synthetic peptide
LQHNNYPFT

SEQ ID NO: 994 - protein, 9 aa, Artificial Sequence
  Description of Artificial Sequence: Synthetic peptide
LQHNNYPFT

SEQ ID NO: 995 - protein, 9 aa, Artificial Sequence
  Description of Artificial Sequence: Synthetic peptide
LQHNNYPFT

SEQ ID NO: 996 - protein, 9 aa, Artificial Sequence
  Description of Artificial Sequence: Synthetic peptide
LQHNNYPFT

SEQ ID NO: 997 - protein, 9 aa, Artificial Sequence
  Description of Artificial Sequence: Synthetic peptide
LQHNNYPFT

SEQ ID NO: 998 - protein, 8 aa, Artificial Sequence
  Description of Artificial Sequence: Synthetic peptide
QQYDDLFT

SEQ ID NO: 999 - protein, 8 aa, Artificial Sequence
  Description of Artificial Sequence: Synthetic peptide
QQYDDLFT

SEQ ID NO: 1000 - protein, 8 aa, Artificial Sequence
  Description of Artificial Sequence: Synthetic peptide
QQYDDLFT

SEQ ID NO: 1001 - protein, 8 aa, Artificial Sequence
  Description of Artificial Sequence: Synthetic peptide
QQYDDLFT

SEQ ID NO: 1002 - protein, 8 aa, Artificial Sequence
  Description of Artificial Sequence: Synthetic peptide
QQYDDLFT

SEQ ID NO: 1003 - protein, 8 aa, Artificial Sequence
  Description of Artificial Sequence: Synthetic peptide
QQYDDLFT

SEQ ID NO: 1004 - protein, 8 aa, Artificial Sequence
  Description of Artificial Sequence: Synthetic peptide
QQYDDLFT

SEQ ID NO: 1005 - protein, 8 aa, Artificial Sequence
  Description of Artificial Sequence: Synthetic peptide
QQYDDLFT

SEQ ID NO: 1006 - protein, 8 aa, Artificial Sequence
  Description of Artificial Sequence: Synthetic peptide
QQYDDLFT

SEQ ID NO: 1007 - protein, 8 aa, Artificial Sequence
  Description of Artificial Sequence: Synthetic peptide
QQYDDLFT

SEQ ID NO: 1008 - protein, 8 aa, Artificial Sequence
  Description of Artificial Sequence: Synthetic peptide
QQYDDLFT

SEQ ID NO: 1009 - protein, 8 aa, Artificial Sequence
  Description of Artificial Sequence: Synthetic peptide
QQYGSSPR

SEQ ID NO: 1010 - protein, 8 aa, Artificial Sequence
  Description of Artificial Sequence: Synthetic peptide
QQYGSSPR

SEQ ID NO: 1011 - protein, 8 aa, Artificial Sequence
  Description of Artificial Sequence: Synthetic peptide
QQYGSSPR

SEQ ID NO: 1012 - protein, 8 aa, Artificial Sequence
  Description of Artificial Sequence: Synthetic peptide
QQYGSSPR

SEQ ID NO: 1013 - protein, 9 aa, Artificial Sequence
  Description of Artificial Sequence: Synthetic peptide
QQYNNWPLT

SEQ ID NO: 1014 - protein, 9 aa, Artificial Sequence
  Description of Artificial Sequence: Synthetic peptide
QQYNNWPLT

SEQ ID NO: 1015 - protein, 9 aa, Artificial Sequence
  Description of Artificial Sequence: Synthetic peptide
QQYNNWPLT

SEQ ID NO: 1016 - protein, 9 aa, Artificial Sequence
  Description of Artificial Sequence: Synthetic peptide
QQYNNWPLT

SEQ ID NO: 1017 - protein, 9 aa, Artificial Sequence
  Description of Artificial Sequence: Synthetic peptide
QQYNNFPLT

SEQ ID NO: 1018 - protein, 9 aa, Artificial Sequence
  Description of Artificial Sequence: Synthetic peptide
QQYNNYPLT

SEQ ID NO: 1019 - protein, 9 aa, Artificial Sequence
  Description of Artificial Sequence: Synthetic peptide
QQYNNWPLT

SEQ ID NO: 1020 - protein, 9 aa, Artificial Sequence
  Description of Artificial Sequence: Synthetic peptide
QQYNNWPLT

SEQ ID NO: 1021 - protein, 9 aa, Artificial Sequence
  Description of Artificial Sequence: Synthetic peptide
QQYGSSPLT

SEQ ID NO: 1022 - protein, 9 aa, Artificial Sequence
  Description of Artificial Sequence: Synthetic peptide
QQYGSSPLT

SEQ ID NO: 1023 - protein, 9 aa, Artificial Sequence
  Description of Artificial Sequence: Synthetic peptide
QQYGSSPLT

SEQ ID NO: 1024 - protein, 9 aa, Artificial Sequence
  Description of Artificial Sequence: Synthetic peptide
QQYGSSPLT

SEQ ID NO: 1025 - protein, 9 aa, Artificial Sequence
  Description of Artificial Sequence: Synthetic peptide
QQYGSSPLT

SEQ ID NO: 1026 - protein, 9 aa, Artificial Sequence
  Description of Artificial Sequence: Synthetic peptide
QQYGSSPLT

SEQ ID NO: 1027 - protein, 9 aa, Artificial Sequence
  Description of Artificial Sequence: Synthetic peptide
QQYGSSPLT

SEQ ID NO: 1028 - protein, 9 aa, Artificial Sequence
  Description of Artificial Sequence: Synthetic peptide
QQYYSTPWT

SEQ ID NO: 1029 - protein, 9 aa, Artificial Sequence
  Description of Artificial Sequence: Synthetic peptide
QQYYSTPWT

SEQ ID NO: 1030 - protein, 9 aa, Artificial Sequence
  Description of Artificial Sequence: Synthetic peptide
QQYYSTPWT

SEQ ID NO: 1031 - protein, 9 aa, Artificial Sequence
  Description of Artificial Sequence: Synthetic peptide
QQYYSTPWT

SEQ ID NO: 1032 - protein, 9 aa, Artificial Sequence
  Description of Artificial Sequence: Synthetic peptide
QQYYSTPWT

SEQ ID NO: 1033 - protein, 9 aa, Artificial Sequence
  Description of Artificial Sequence: Synthetic peptide
QQYYSTPWT

SEQ ID NO: 1034 - protein, 9 aa, Artificial Sequence
  Description of Artificial Sequence: Synthetic peptide
QQYYSTPWT

SEQ ID NO: 1035 - protein, 9 aa, Artificial Sequence
  Description of Artificial Sequence: Synthetic peptide
QQYYSTPWT

SEQ ID NO: 1036 - protein, 9 aa, Artificial Sequence
  Description of Artificial Sequence: Synthetic peptide
QQYYSTPWT

SEQ ID NO: 1037 - protein, 9 aa, Artificial Sequence
  Description of Artificial Sequence: Synthetic peptide
QQYYSTPWT

SEQ ID NO: 1038 - protein, 9 aa, Artificial Sequence
  Description of Artificial Sequence: Synthetic peptide
QQYYSTPWT

SEQ ID NO: 1039 - protein, 9 aa, Artificial Sequence
  Description of Artificial Sequence: Synthetic peptide
QQYYRTPWT

SEQ ID NO: 1040 - protein, 9 aa, Artificial Sequence
  Description of Artificial Sequence: Synthetic peptide
QQYYRTPWT

SEQ ID NO: 1041 - protein, 9 aa, Artificial Sequence
  Description of Artificial Sequence: Synthetic peptide
QQYYRTPWT

SEQ ID NO: 1042 - protein, 9 aa, Artificial Sequence
  Description of Artificial Sequence: Synthetic peptide
QQYYRTPWT

SEQ ID NO: 1043 - protein, 9 aa, Artificial Sequence
  Description of Artificial Sequence: Synthetic peptide
QQYYRTPWT

SEQ ID NO: 1044 - protein, 9 aa, Artificial Sequence
  Description of Artificial Sequence: Synthetic peptide
QQYYRTPWT

SEQ ID NO: 1045 - protein, 9 aa, Artificial Sequence
  Description of Artificial Sequence: Synthetic peptide
QQYYRTPWT

SEQ ID NO: 1046 - protein, 9 aa, Artificial Sequence
  Description of Artificial Sequence: Synthetic peptide
QQYYRTPWT

SEQ ID NO: 1047 - protein, 9 aa, Artificial Sequence
  Description of Artificial Sequence: Synthetic peptide
QQYYRTPWT

SEQ ID NO: 1048 - protein, 9 aa, Artificial Sequence
  Description of Artificial Sequence: Synthetic peptide
QQYYSTPWT

SEQ ID NO: 1049 - protein, 9 aa, Artificial Sequence
  Description of Artificial Sequence: Synthetic peptide
QQYYSTPWT

SEQ ID NO: 1050 - protein, 9 aa, Artificial Sequence
  Description of Artificial Sequence: Synthetic peptide
QQYYSTPWT

SEQ ID NO: 1051 - protein, 9 aa, Artificial Sequence
  Description of Artificial Sequence: Synthetic peptide
QQYYSTPWT

SEQ ID NO: 1052 - protein, 9 aa, Artificial Sequence
  Description of Artificial Sequence: Synthetic peptide
QQYYSTPWT

SEQ ID NO: 1053 - protein, 9 aa, Artificial Sequence
  Description of Artificial Sequence: Synthetic peptide
QQYYRTPWT

SEQ ID NO: 1054 - protein, 9 aa, Artificial Sequence
  Description of Artificial Sequence: Synthetic peptide
QQYYRTPWT

SEQ ID NO: 1055 - protein, 9 aa, Artificial Sequence
  Description of Artificial Sequence: Synthetic peptide
QQYYRTPWT

SEQ ID NO: 1056 - protein, 9 aa, Artificial Sequence
  Description of Artificial Sequence: Synthetic peptide
QQYYRTPWT

SEQ ID NO: 1057 - protein, 9 aa, Artificial Sequence
  Description of Artificial Sequence: Synthetic peptide
QQYYRTPWT

SEQ ID NO: 1058 - protein, 9 aa, Artificial Sequence
  Description of Artificial Sequence: Synthetic peptide
QQYYRTPWT

SEQ ID NO: 1059 - protein, 9 aa, Artificial Sequence
  Description of Artificial Sequence: Synthetic peptide
QQYYRTPWT

SEQ ID NO: 1060 - protein, 9 aa, Artificial Sequence
  Description of Artificial Sequence: Synthetic peptide
QQYYRTPWT

SEQ ID NO: 1061 - protein, 9 aa, Artificial Sequence
  Description of Artificial Sequence: Synthetic peptide
QQYYRTPWT

SEQ ID NO: 1062 - protein, 9 aa, Artificial Sequence
  Description of Artificial Sequence: Synthetic peptide
QQYYRTPWT

SEQ ID NO: 1063 - protein, 9 aa, Artificial Sequence
  Description of Artificial Sequence: Synthetic peptide
QQYYRTPWT

SEQ ID NO: 1064 - protein, 9 aa, Artificial Sequence
  Description of Artificial Sequence: Synthetic peptide
QQYYRTPWT

SEQ ID NO: 1065 - protein, 9 aa, Artificial Sequence
  Description of Artificial Sequence: Synthetic peptide
QQYYRTPWT

SEQ ID NO: 1066 - protein, 11 aa, Artificial Sequence
  Description of Artificial Sequence: Synthetic peptide
ATFDESLSGPV

SEQ ID NO: 1067 - protein, 11 aa, Artificial Sequence
  Description of Artificial Sequence: Synthetic peptide
ATFDESLQGPV

SEQ ID NO: 1068 - protein, 11 aa, Artificial Sequence
  Description of Artificial Sequence: Synthetic peptide
ATFDESLSGPV

SEQ ID NO: 1069 - protein, 11 aa, Artificial Sequence
  Description of Artificial Sequence: Synthetic peptide
ATFDESLQGPV

SEQ ID NO: 1070 - protein, 11 aa, Artificial Sequence
  Description of Artificial Sequence: Synthetic peptide
ATFDDSLNGPV

SEQ ID NO: 1071 - protein, 11 aa, Artificial Sequence
  Description of Artificial Sequence: Synthetic peptide
ATFDDSLNGPV

SEQ ID NO: 1072 - protein, 11 aa, Artificial Sequence
  Description of Artificial Sequence: Synthetic peptide
ATFDESLNGPV

SEQ ID NO: 1073 - protein, 11 aa, Artificial Sequence
  Description of Artificial Sequence: Synthetic peptide
ATFDDSLQGPV

SEQ ID NO: 1074 - protein, 11 aa, Artificial Sequence
  Description of Artificial Sequence: Synthetic peptide
ATFDDSLSGPV

SEQ ID NO: 1075 - protein, 11 aa, Artificial Sequence
  Description of Artificial Sequence: Synthetic peptide
ATFDDSLNAPV

SEQ ID NO: 1076 - protein, 11 aa, Artificial Sequence
  Description of Artificial Sequence: Synthetic peptide
ATFDSSLNGPV

SEQ ID NO: 1077 - protein, 11 aa, Artificial Sequence
  Description of Artificial Sequence: Synthetic peptide
ATFDSSLNAPV

SEQ ID NO: 1078 - protein, 11 aa, Artificial Sequence
  Description of Artificial Sequence: Synthetic peptide
ATFDSSLNAPV

SEQ ID NO: 1079 - protein, 11 aa, Artificial Sequence
  Description of Artificial Sequence: Synthetic peptide
ATFDESLSGPV

SEQ ID NO: 1080 - protein, 9 aa, Artificial Sequence
  Description of Artificial Sequence: Synthetic peptide
LQHNNYPFT

SEQ ID NO: 1081 - protein, 9 aa, Artificial Sequence
  Description of Artificial Sequence: Synthetic peptide
LQHNNYPFT

SEQ ID NO: 1082 - protein, 11 aa, Artificial Sequence
  Description of Artificial Sequence: Synthetic peptide
ATFDSSLSGPV

SEQ ID NO: 1083 - protein, 9 aa, Artificial Sequence
  Description of Artificial Sequence: Synthetic peptide
QQSYSTLIS

SEQ ID NO: 1084 - protein, 11 aa, Artificial Sequence
  Description of Artificial Sequence: Synthetic peptide
GTWDSSLSAVV

SEQ ID NO: 1085 - protein, 9 aa, Artificial Sequence
  Description of Artificial Sequence: Synthetic peptide
QQSYSTLIS

SEQ ID NO: 1086 - protein, 9 aa, Artificial Sequence
  Description of Artificial Sequence: Synthetic peptide
QQSYSTLIS

SEQ ID NO: 1087 - protein, 9 aa, Artificial Sequence
  Description of Artificial Sequence: Synthetic peptide
QQSYSTLIS

SEQ ID NO: 1088 - protein, 9 aa, Artificial Sequence
  Description of Artificial Sequence: Synthetic peptide
QQSYSTLIS

SEQ ID NO: 1089 - protein, 9 aa, Artificial Sequence
  Description of Artificial Sequence: Synthetic peptide
QQSYSTLIS

SEQ ID NO: 1090 - protein, 9 aa, Artificial Sequence
  Description of Artificial Sequence: Synthetic peptide
QQSYSTLIS

SEQ ID NO: 1091 - protein, 11 aa, Artificial Sequence
  Description of Artificial Sequence: Synthetic peptide
GTWDSSLSAVV

SEQ ID NO: 1092 - protein, 11 aa, Artificial Sequence
  Description of Artificial Sequence: Synthetic peptide
GTWDSSLSAVV

SEQ ID NO: 1093 - protein, 11 aa, Artificial Sequence
  Description of Artificial Sequence: Synthetic peptide
GTWDSSLSAVV

SEQ ID NO: 1094 - protein, 11 aa, Artificial Sequence
  Description of Artificial Sequence: Synthetic peptide
GTFESSLSAVV

SEQ ID NO: 1095 - protein, 11 aa, Artificial Sequence
  Description of Artificial Sequence: Synthetic peptide
GTWDSSLSAVV

SEQ ID NO: 1096 - protein, 11 aa, Artificial Sequence
  Description of Artificial Sequence: Synthetic peptide
GTWDSSLSAVV

SEQ ID NO: 1097 - protein, 11 aa, Artificial Sequence
  Description of Artificial Sequence: Synthetic peptide
GTWDSSLSAVV

SEQ ID NO: 1098 - protein, 11 aa, Artificial Sequence
  Description of Artificial Sequence: Synthetic peptide
GTFESSLSAVV

SEQ ID NO: 1099 - protein, 9 aa, Artificial Sequence
  Description of Artificial Sequence: Synthetic peptide
QQSYSTLLS

SEQ ID NO: 1100 - protein, 5 aa, Artificial Sequence
  Description of Artificial Sequence: Synthetic peptide
GYYMH

SEQ ID NO: 1101 - protein, 5 aa, Artificial Sequence
  Description of Artificial Sequence: Synthetic peptide
NFGMH

SEQ ID NO: 1102 - protein, 5 aa, Artificial Sequence
  Description of Artificial Sequence: Synthetic peptide
YFGMH

SEQ ID NO: 1103 - protein, 5 aa, Artificial Sequence
  Description of Artificial Sequence: Synthetic peptide
SYGMH

SEQ ID NO: 1104 - protein, 5 aa, Artificial Sequence
  Description of Artificial Sequence: Synthetic peptide
GYYIH

SEQ ID NO: 1105 - protein, 5 aa, Artificial Sequence
  Description of Artificial Sequence: Synthetic peptide
GYYIH

SEQ ID NO: 1106 - protein, 5 aa, Artificial Sequence
  Description of Artificial Sequence: Synthetic peptide
GYYIH

SEQ ID NO: 1107 - protein, 5 aa, Artificial Sequence
  Description of Artificial Sequence: Synthetic peptide
GYYIH

SEQ ID NO: 1108 - protein, 7 aa, Artificial Sequence
  Description of Artificial Sequence: Synthetic peptide
SGGYYWS

SEQ ID NO: 1109 - protein, 5 aa, Artificial Sequence
  Description of Artificial Sequence: Synthetic peptide
NYGMH

SEQ ID NO: 1110 - protein, 5 aa, Artificial Sequence
  Description of Artificial Sequence: Synthetic peptide
YFGMH

SEQ ID NO: 1111 - protein, 5 aa, Artificial Sequence
  Description of Artificial Sequence: Synthetic peptide
SYGMH

SEQ ID NO: 1112 - protein, 5 aa, Artificial Sequence
  Description of Artificial Sequence: Synthetic peptide
SYYWS

SEQ ID NO: 1113 - protein, 5 aa, Artificial Sequence
  Description of Artificial Sequence: Synthetic peptide
SYYWS

SEQ ID NO: 1114 - protein, 5 aa, Artificial Sequence
  Description of Artificial Sequence: Synthetic peptide
YFGMH

SEQ ID NO: 1115 - protein, 5 aa, Artificial Sequence
  Description of Artificial Sequence: Synthetic peptide
YFGMH

SEQ ID NO: 1116 - protein, 5 aa, Artificial Sequence
  Description of Artificial Sequence: Synthetic peptide
YFGMH

SEQ ID NO: 1117 - protein, 5 aa, Artificial Sequence
  Description of Artificial Sequence: Synthetic peptide
YFGMH

SEQ ID NO: 1118 - protein, 5 aa, Artificial Sequence
  Description of Artificial Sequence: Synthetic peptide
YFGMH

SEQ ID NO: 1119 - protein, 5 aa, Artificial Sequence
  Description of Artificial Sequence: Synthetic peptide
YFGMH

SEQ ID NO: 1120 - protein, 5 aa, Artificial Sequence
  Description of Artificial Sequence: Synthetic peptide
NFGMH

SEQ ID NO: 1121 - protein, 5 aa, Artificial Sequence
  Description of Artificial Sequence: Synthetic peptide
NFGMH

SEQ ID NO: 1122 - protein, 5 aa, Artificial Sequence
  Description of Artificial Sequence: Synthetic peptide
NFGMH

SEQ ID NO: 1123 - protein, 5 aa, Artificial Sequence
  Description of Artificial Sequence: Synthetic peptide
NFGMH

SEQ ID NO: 1124 - protein, 5 aa, Artificial Sequence
  Description of Artificial Sequence: Synthetic peptide
NFGMH

SEQ ID NO: 1125 - protein, 5 aa, Artificial Sequence
  Description of Artificial Sequence: Synthetic peptide
NFGMH

SEQ ID NO: 1126 - protein, 5 aa, Artificial Sequence
  Description of Artificial Sequence: Synthetic peptide
NFGMH

SEQ ID NO: 1127 - protein, 5 aa, Artificial Sequence
  Description of Artificial Sequence: Synthetic peptide
NFGMH

SEQ ID NO: 1128 - protein, 5 aa, Artificial Sequence
  Description of Artificial Sequence: Synthetic peptide
NFGMH

SEQ ID NO: 1129 - protein, 5 aa, Artificial Sequence
  Description of Artificial Sequence: Synthetic peptide
NFGMH

SEQ ID NO: 1130 - protein, 5 aa, Artificial Sequence
  Description of Artificial Sequence: Synthetic peptide
NFGMH

SEQ ID NO: 1131 - protein, 5 aa, Artificial Sequence
  Description of Artificial Sequence: Synthetic peptide
NFGMH

SEQ ID NO: 1132 - protein, 5 aa, Artificial Sequence
  Description of Artificial Sequence: Synthetic peptide
NFGMH

SEQ ID NO: 1133 - protein, 5 aa, Artificial Sequence
  Description of Artificial Sequence: Synthetic peptide
NFGMH

SEQ ID NO: 1134 - protein, 5 aa, Artificial Sequence
  Description of Artificial Sequence: Synthetic peptide
NFGMH

SEQ ID NO: 1135 - protein, 5 aa, Artificial Sequence
  Description of Artificial Sequence: Synthetic peptide
NFGMH

SEQ ID NO: 1136 - protein, 5 aa, Artificial Sequence
  Description of Artificial Sequence: Synthetic peptide
NFGMH

SEQ ID NO: 1137 - protein, 5 aa, Artificial Sequence
  Description of Artificial Sequence: Synthetic peptide
NFGMH

SEQ ID NO: 1138 - protein, 5 aa, Artificial Sequence
  Description of Artificial Sequence: Synthetic peptide
NFGMH

SEQ ID NO: 1139 - protein, 5 aa, Artificial Sequence
  Description of Artificial Sequence: Synthetic peptide
SYGMH

SEQ ID NO: 1140 - protein, 5 aa, Artificial Sequence
  Description of Artificial Sequence: Synthetic peptide
SYGMH

SEQ ID NO: 1141 - protein, 5 aa, Artificial Sequence
  Description of Artificial Sequence: Synthetic peptide
SYGMH

SEQ ID NO: 1142 - protein, 5 aa, Artificial Sequence
  Description of Artificial Sequence: Synthetic peptide
SYGMH

SEQ ID NO: 1143 - protein, 5 aa, Artificial Sequence
  Description of Artificial Sequence: Synthetic peptide
SYGMH

SEQ ID NO: 1144 - protein, 5 aa, Artificial Sequence
  Description of Artificial Sequence: Synthetic peptide
SYGMH

SEQ ID NO: 1145 - protein, 5 aa, Artificial Sequence
  Description of Artificial Sequence: Synthetic peptide
SYGMH

SEQ ID NO: 1146 - protein, 5 aa, Artificial Sequence
  Description of Artificial Sequence: Synthetic peptide
SYGMH

SEQ ID NO: 1147 - protein, 5 aa, Artificial Sequence
  Description of Artificial Sequence: Synthetic peptide
SYGMH

SEQ ID NO: 1148 - protein, 5 aa, Artificial Sequence
  Description of Artificial Sequence: Synthetic peptide
YFGMH

SEQ ID NO: 1149 - protein, 5 aa, Artificial Sequence
  Description of Artificial Sequence: Synthetic peptide
YFGMH

SEQ ID NO: 1150 - protein, 5 aa, Artificial Sequence
  Description of Artificial Sequence: Synthetic peptide
YFGMH

SEQ ID NO: 1151 - protein, 5 aa, Artificial Sequence
  Description of Artificial Sequence: Synthetic peptide
YFGMH

SEQ ID NO: 1152 - protein, 5 aa, Artificial Sequence
  Description of Artificial Sequence: Synthetic peptide
YFGMH

SEQ ID NO: 1153 - protein, 5 aa, Artificial Sequence
  Description of Artificial Sequence: Synthetic peptide
YFGMH

SEQ ID NO: 1154 - protein, 5 aa, Artificial Sequence
  Description of Artificial Sequence: Synthetic peptide
YFGMH

SEQ ID NO: 1155 - protein, 5 aa, Artificial Sequence
  Description of Artificial Sequence: Synthetic peptide
SYGMH

SEQ ID NO: 1156 - protein, 5 aa, Artificial Sequence
  Description of Artificial Sequence: Synthetic peptide
SYGMH

SEQ ID NO: 1157 - protein, 5 aa, Artificial Sequence
  Description of Artificial Sequence: Synthetic peptide
SYGMH

SEQ ID NO: 1158 - protein, 5 aa, Artificial Sequence
  Description of Artificial Sequence: Synthetic peptide
SYGMH

SEQ ID NO: 1159 - protein, 5 aa, Artificial Sequence
  Description of Artificial Sequence: Synthetic peptide
SYGMH

SEQ ID NO: 1160 - protein, 5 aa, Artificial Sequence
  Description of Artificial Sequence: Synthetic peptide
SYGMH

SEQ ID NO: 1161 - protein, 5 aa, Artificial Sequence
  Description of Artificial Sequence: Synthetic peptide
SYGMH

SEQ ID NO: 1162 - protein, 5 aa, Artificial Sequence
  Description of Artificial Sequence: Synthetic peptide
SYGMH

SEQ ID NO: 1163 - protein, 5 aa, Artificial Sequence
  Description of Artificial Sequence: Synthetic peptide
SYGMH

SEQ ID NO: 1164 - protein, 5 aa, Artificial Sequence
  Description of Artificial Sequence: Synthetic peptide
SYGMH

SEQ ID NO: 1165 - protein, 5 aa, Artificial Sequence
  Description of Artificial Sequence: Synthetic peptide
SYGMH

SEQ ID NO: 1166 - protein, 5 aa, Artificial Sequence
  Description of Artificial Sequence: Synthetic peptide
SYGMH

SEQ ID NO: 1167 - protein, 5 aa, Artificial Sequence
  Description of Artificial Sequence: Synthetic peptide
SYGMH

SEQ ID NO: 1168 - protein, 5 aa, Artificial Sequence
  Description of Artificial Sequence: Synthetic peptide
SYGMH

SEQ ID NO: 1169 - protein, 5 aa, Artificial Sequence
  Description of Artificial Sequence: Synthetic peptide
SYGMH

SEQ ID NO: 1170 - protein, 5 aa, Artificial Sequence
  Description of Artificial Sequence: Synthetic peptide
NYGMH

SEQ ID NO: 1171 - protein, 5 aa, Artificial Sequence
  Description of Artificial Sequence: Synthetic peptide
NYGMH

SEQ ID NO: 1172 - protein, 5 aa, Artificial Sequence
  Description of Artificial Sequence: Synthetic peptide
NYGMH

SEQ ID NO: 1173 - protein, 5 aa, Artificial Sequence
  Description of Artificial Sequence: Synthetic peptide
NYGMH

SEQ ID NO: 1174 - protein, 5 aa, Artificial Sequence
  Description of Artificial Sequence: Synthetic peptide
NYGMH

SEQ ID NO: 1175 - protein, 5 aa, Artificial Sequence
  Description of Artificial Sequence: Synthetic peptide
NYGMH

SEQ ID NO: 1176 - protein, 5 aa, Artificial Sequence
  Description of Artificial Sequence: Synthetic peptide
NYGMH

SEQ ID NO: 1177 - protein, 5 aa, Artificial Sequence
  Description of Artificial Sequence: Synthetic peptide
NYGMH

SEQ ID NO: 1178 - protein, 7 aa, Artificial Sequence
  Description of Artificial Sequence: Synthetic peptide
SGGYYWS

SEQ ID NO: 1179 - protein, 7 aa, Artificial Sequence
  Description of Artificial Sequence: Synthetic peptide
SGGYYWS

SEQ ID NO: 1180 - protein, 7 aa, Artificial Sequence
  Description of Artificial Sequence: Synthetic peptide
SGGYYWS

SEQ ID NO: 1181 - protein, 7 aa, Artificial Sequence
  Description of Artificial Sequence: Synthetic peptide
SGGYYWS

SEQ ID NO: 1182 - protein, 7 aa, Artificial Sequence
  Description of Artificial Sequence: Synthetic peptide
SGGYYWS

SEQ ID NO: 1183 - protein, 7 aa, Artificial Sequence
  Description of Artificial Sequence: Synthetic peptide
SGGYYWS

SEQ ID NO: 1184 - protein, 7 aa, Artificial Sequence
  Description of Artificial Sequence: Synthetic peptide
SGGYYWS

SEQ ID NO: 1185 - protein, 5 aa, Artificial Sequence
  Description of Artificial Sequence: Synthetic peptide
GYYIH

SEQ ID NO: 1186 - protein, 5 aa, Artificial Sequence
  Description of Artificial Sequence: Synthetic peptide
GYYIH

SEQ ID NO: 1187 - protein, 5 aa, Artificial Sequence
  Description of Artificial Sequence: Synthetic peptide
GYYIH

SEQ ID NO: 1188 - protein, 5 aa, Artificial Sequence
  Description of Artificial Sequence: Synthetic peptide
GYYIH

SEQ ID NO: 1189 - protein, 5 aa, Artificial Sequence
  Description of Artificial Sequence: Synthetic peptide
GYYIH

SEQ ID NO: 1190 - protein, 5 aa, Artificial Sequence
  Description of Artificial Sequence: Synthetic peptide
GYYIH

SEQ ID NO: 1191 - protein, 5 aa, Artificial Sequence
  Description of Artificial Sequence: Synthetic peptide
GYYIH

SEQ ID NO: 1192 - protein, 5 aa, Artificial Sequence
  Description of Artificial Sequence: Synthetic peptide
GYYIH

SEQ ID NO: 1193 - protein, 5 aa, Artificial Sequence
  Description of Artificial Sequence: Synthetic peptide
GYYIH

SEQ ID NO: 1194 - protein, 5 aa, Artificial Sequence
  Description of Artificial Sequence: Synthetic peptide
GYYIH

SEQ ID NO: 1195 - protein, 5 aa, Artificial Sequence
  Description of Artificial Sequence: Synthetic peptide
GYYIH

SEQ ID NO: 1196 - protein, 5 aa, Artificial Sequence
  Description of Artificial Sequence: Synthetic peptide
GYYIH

SEQ ID NO: 1197 - protein, 5 aa, Artificial Sequence
  Description of Artificial Sequence: Synthetic peptide
GYYIH

SEQ ID NO: 1198 - protein, 5 aa, Artificial Sequence
  Description of Artificial Sequence: Synthetic peptide
GYYIH

SEQ ID NO: 1199 - protein, 5 aa, Artificial Sequence
  Description of Artificial Sequence: Synthetic peptide
GYYIH

SEQ ID NO: 1200 - protein, 5 aa, Artificial Sequence
  Description of Artificial Sequence: Synthetic peptide
GYYIH

SEQ ID NO: 1201 - protein, 5 aa, Artificial Sequence
  Description of Artificial Sequence: Synthetic peptide
GYYIH

SEQ ID NO: 1202 - protein, 5 aa, Artificial Sequence
  Description of Artificial Sequence: Synthetic peptide
GYYIH

SEQ ID NO: 1203 - protein, 5 aa, Artificial Sequence
  Description of Artificial Sequence: Synthetic peptide
GYYIH

SEQ ID NO: 1204 - protein, 5 aa, Artificial Sequence
  Description of Artificial Sequence: Synthetic peptide
GYYIH

SEQ ID NO: 1205 - protein, 5 aa, Artificial Sequence
  Description of Artificial Sequence: Synthetic peptide
GYYIH

SEQ ID NO: 1206 - protein, 5 aa, Artificial Sequence
  Description of Artificial Sequence: Synthetic peptide
GYYIH

SEQ ID NO: 1207 - protein, 5 aa, Artificial Sequence
  Description of Artificial Sequence: Synthetic peptide
GYYIH

SEQ ID NO: 1208 - protein, 5 aa, Artificial Sequence
  Description of Artificial Sequence: Synthetic peptide
GYYIH

SEQ ID NO: 1209 - protein, 5 aa, Artificial Sequence
  Description of Artificial Sequence: Synthetic peptide
GYYIH

SEQ ID NO: 1210 - protein, 5 aa, Artificial Sequence
  Description of Artificial Sequence: Synthetic peptide
GYYIH

SEQ ID NO: 1211 - protein, 5 aa, Artificial Sequence
  Description of Artificial Sequence: Synthetic peptide
GYYIH

SEQ ID NO: 1212 - protein, 5 aa, Artificial Sequence
  Description of Artificial Sequence: Synthetic peptide
GYYIH

SEQ ID NO: 1213 - protein, 5 aa, Artificial Sequence
  Description of Artificial Sequence: Synthetic peptide
GYYIH

SEQ ID NO: 1214 - protein, 5 aa, Artificial Sequence
  Description of Artificial Sequence: Synthetic peptide
GYYIH

SEQ ID NO: 1215 - protein, 5 aa, Artificial Sequence
  Description of Artificial Sequence: Synthetic peptide
GYYIH

SEQ ID NO: 1216 - protein, 5 aa, Artificial Sequence
  Description of Artificial Sequence: Synthetic peptide
GYYIH

SEQ ID NO: 1217 - protein, 5 aa, Artificial Sequence
  Description of Artificial Sequence: Synthetic peptide
GYYIH

SEQ ID NO: 1218 - protein, 5 aa, Artificial Sequence
  Description of Artificial Sequence: Synthetic peptide
GYYIH

SEQ ID NO: 1219 - protein, 5 aa, Artificial Sequence
  Description of Artificial Sequence: Synthetic peptide
GYYIH

SEQ ID NO: 1220 - protein, 5 aa, Artificial Sequence
  Description of Artificial Sequence: Synthetic peptide
GYYIH

SEQ ID NO: 1221 - protein, 5 aa, Artificial Sequence
  Description of Artificial Sequence: Synthetic peptide
GYYIH

SEQ ID NO: 1222 - protein, 5 aa, Artificial Sequence
  Description of Artificial Sequence: Synthetic peptide
GYYIH

SEQ ID NO: 1223 - protein, 5 aa, Artificial Sequence
  Description of Artificial Sequence: Synthetic peptide
GYYMH

SEQ ID NO: 1224 - protein, 5 aa, Artificial Sequence
  Description of Artificial Sequence: Synthetic peptide
GYYMH

SEQ ID NO: 1225 - protein, 5 aa, Artificial Sequence
  Description of Artificial Sequence: Synthetic peptide
GYYMH

SEQ ID NO: 1226 - protein, 5 aa, Artificial Sequence
  Description of Artificial Sequence: Synthetic peptide
GYYMH

SEQ ID NO: 1227 - protein, 5 aa, Artificial Sequence
  Description of Artificial Sequence: Synthetic peptide
GYYMH

SEQ ID NO: 1228 - protein, 5 aa, Artificial Sequence
  Description of Artificial Sequence: Synthetic peptide
GYYMH

SEQ ID NO: 1229 - protein, 5 aa, Artificial Sequence
  Description of Artificial Sequence: Synthetic peptide
GYYMH

SEQ ID NO: 1230 - protein, 5 aa, Artificial Sequence
  Description of Artificial Sequence: Synthetic peptide
GYYMH

SEQ ID NO: 1231 - protein, 5 aa, Artificial Sequence
  Description of Artificial Sequence: Synthetic peptide
GYYMH

SEQ ID NO: 1232 - protein, 5 aa, Artificial Sequence
  Description of Artificial Sequence: Synthetic peptide
GYYMH

SEQ ID NO: 1233 - protein, 5 aa, Artificial Sequence
  Description of Artificial Sequence: Synthetic peptide
GYYMH

SEQ ID NO: 1234 - protein, 5 aa, Artificial Sequence
  Description of Artificial Sequence: Synthetic peptide
GYYMH

SEQ ID NO: 1235 - protein, 5 aa, Artificial Sequence
  Description of Artificial Sequence: Synthetic peptide
GYYMH

SEQ ID NO: 1236 - protein, 5 aa, Artificial Sequence
  Description of Artificial Sequence: Synthetic peptide
GYYMH

SEQ ID NO: 1237 - protein, 5 aa, Artificial Sequence
  Description of Artificial Sequence: Synthetic peptide
NFGMH

SEQ ID NO: 1238 - protein, 5 aa, Artificial Sequence
  Description of Artificial Sequence: Synthetic peptide
YFGMH

SEQ ID NO: 1239 - protein, 5 aa, Artificial Sequence
  Description of Artificial Sequence: Synthetic peptide
GYYMH

SEQ ID NO: 1240 - protein, 5 aa, Artificial Sequence
  Description of Artificial Sequence: Synthetic peptide
SYGIH

SEQ ID NO: 1241 - protein, 5 aa, Artificial Sequence
  Description of Artificial Sequence: Synthetic peptide
SYDIN

SEQ ID NO: 1242 - protein, 5 aa, Artificial Sequence
  Description of Artificial Sequence: Synthetic peptide
SYGIH

SEQ ID NO: 1243 - protein, 5 aa, Artificial Sequence
  Description of Artificial Sequence: Synthetic peptide
SYGIH

SEQ ID NO: 1244 - protein, 5 aa, Artificial Sequence
  Description of Artificial Sequence: Synthetic peptide
SYGIH

SEQ ID NO: 1245 - protein, 5 aa, Artificial Sequence
  Description of Artificial Sequence: Synthetic peptide
SYGIH

SEQ ID NO: 1246 - protein, 5 aa, Artificial Sequence
  Description of Artificial Sequence: Synthetic peptide
SYGIH

SEQ ID NO: 1247 - protein, 5 aa, Artificial Sequence
  Description of Artificial Sequence: Synthetic peptide
SYGIH

SEQ ID NO: 1248 - protein, 5 aa, Artificial Sequence
  Description of Artificial Sequence: Synthetic peptide
SYDIN

SEQ ID NO: 1249 - protein, 5 aa, Artificial Sequence
  Description of Artificial Sequence: Synthetic peptide
SYDIN

SEQ ID NO: 1250 - protein, 5 aa, Artificial Sequence
  Description of Artificial Sequence: Synthetic peptide
SYDIN

SEQ ID NO: 1251 - protein, 5 aa, Artificial Sequence
  Description of Artificial Sequence: Synthetic peptide
SYDIN

SEQ ID NO: 1252 - protein, 5 aa, Artificial Sequence
  Description of Artificial Sequence: Synthetic peptide
SYDIN

SEQ ID NO: 1253 - protein, 5 aa, Artificial Sequence
  Description of Artificial Sequence: Synthetic peptide
SYDIN

SEQ ID NO: 1254 - protein, 5 aa, Artificial Sequence
  Description of Artificial Sequence: Synthetic peptide
SYDIN

SEQ ID NO: 1255 - protein, 5 aa, Artificial Sequence
  Description of Artificial Sequence: Synthetic peptide
SYDIN

SEQ ID NO: 1256 - protein, 5 aa, Artificial Sequence
  Description of Artificial Sequence: Synthetic peptide
SYGIH

SEQ ID NO: 1257 - protein, 17 aa, Artificial Sequence
  Description of Artificial Sequence: Synthetic peptide
WINPNSGGTNYAQKFQG

SEQ ID NO: 1258 - protein, 17 aa, Artificial Sequence
  Description of Artificial Sequence: Synthetic peptide
VIWYDGSNENYADSVKG

SEQ ID NO: 1259 - protein, 17 aa, Artificial Sequence
  Description of Artificial Sequence: Synthetic peptide
VIWYDGSNKYYADSVKG

SEQ ID NO: 1260 - protein, 17 aa, Artificial Sequence
  Description of Artificial Sequence: Synthetic peptide
VIWYDGSNKYYADSVKG

SEQ ID NO: 1261 - protein, 17 aa, Artificial Sequence
  Description of Artificial Sequence: Synthetic peptide
WINPDSGGTDYSQRFQG

SEQ ID NO: 1262 - protein, 17 aa, Artificial Sequence
  Description of Artificial Sequence: Synthetic peptide
WINPDSGGTDYSQRFQG

SEQ ID NO: 1263 - protein, 17 aa, Artificial Sequence
  Description of Artificial Sequence: Synthetic peptide
WISPNSGDTSYAQKFQD

SEQ ID NO: 1264 - protein, 17 aa, Artificial Sequence
  Description of Artificial Sequence: Synthetic peptide
WISPNNGDTNYAQKFQD

SEQ ID NO: 1265 - protein, 16 aa, Artificial Sequence
  Description of Artificial Sequence: Synthetic peptide
YIYYSGSTYYNPSLKS

SEQ ID NO: 1266 - protein, 17 aa, Artificial Sequence
  Description of Artificial Sequence: Synthetic peptide
AIWFDGSDKYYADSVKG

SEQ ID NO: 1267 - protein, 17 aa, Artificial Sequence
  Description of Artificial Sequence: Synthetic peptide
VIWYDGSNKYYADSVKG

SEQ ID NO: 1268 - protein, 17 aa, Artificial Sequence
  Description of Artificial Sequence: Synthetic peptide
AIWYDGNNKYYADSVKG

SEQ ID NO: 1269 - protein, 16 aa, Artificial Sequence
  Description of Artificial Sequence: Synthetic peptide
RIYTSGSTNYNPSLKS

SEQ ID NO: 1270 - protein, 16 aa, Artificial Sequence
  Description of Artificial Sequence: Synthetic peptide
RIYTSGSTNYNPSLKS

SEQ ID NO: 1271 - protein, 17 aa, Artificial Sequence
  Description of Artificial Sequence: Synthetic peptide
VIWYDASNKYYADAVKG

SEQ ID NO: 1272 - protein, 17 aa, Artificial Sequence
  Description of Artificial Sequence: Synthetic peptide
VIWYDASNKYYADSVKG

SEQ ID NO: 1273 - protein, 17 aa, Artificial Sequence
  Description of Artificial Sequence: Synthetic peptide
VIWYDGSNKYYADAVKG

SEQ ID NO: 1274 - protein, 17 aa, Artificial Sequence
  Description of Artificial Sequence: Synthetic peptide
VIWYDASNKYYADAVKG

SEQ ID NO: 1275 - protein, 17 aa, Artificial Sequence
  Description of Artificial Sequence: Synthetic peptide
VIWYDASNKYYADAVKG

SEQ ID NO: 1276 - protein, 17 aa, Artificial Sequence
  Description of Artificial Sequence: Synthetic peptide
VIWYDASNKYYADAVKG

SEQ ID NO: 1277 - protein, 17 aa, Artificial Sequence
  Description of Artificial Sequence: Synthetic peptide
VIWYDASNENYADAVKG

SEQ ID NO: 1278 - protein, 17 aa, Artificial Sequence
  Description of Artificial Sequence: Synthetic peptide
VIWYDASNENYADAVKG

SEQ ID NO: 1279 - protein, 17 aa, Artificial Sequence
  Description of Artificial Sequence: Synthetic peptide
VIWYDASNENYADAVKG

SEQ ID NO: 1280 - protein, 17 aa, Artificial Sequence
  Description of Artificial Sequence: Synthetic peptide
VIWYDASNENYADSVKG

SEQ ID NO: 1281 - protein, 17 aa, Artificial Sequence
  Description of Artificial Sequence: Synthetic peptide
VIWYDGSNENYADAVKG

SEQ ID NO: 1282 - protein, 17 aa, Artificial Sequence
  Description of Artificial Sequence: Synthetic peptide
VIWYDASNENYADAVKG

SEQ ID NO: 1283 - protein, 17 aa, Artificial Sequence
  Description of Artificial Sequence: Synthetic peptide
VIWYDASNENYADAVKG

SEQ ID NO: 1284 - protein, 17 aa, Artificial Sequence
  Description of Artificial Sequence: Synthetic peptide
VIWYDGSNENYADSVKG

SEQ ID NO: 1285 - protein, 17 aa, Artificial Sequence
  Description of Artificial Sequence: Synthetic peptide
VIWYDASNENYADAVKG

SEQ ID NO: 1286 - protein, 17 aa, Artificial Sequence
  Description of Artificial Sequence: Synthetic peptide
VIWYDASNENYADAVKG

SEQ ID NO: 1287 - protein, 17 aa, Artificial Sequence
  Description of Artificial Sequence: Synthetic peptide
VIWYDASNENYADAVKG

SEQ ID NO: 1288 - protein, 17 aa, Artificial Sequence
  Description of Artificial Sequence: Synthetic peptide
VIWYDASNENYADAVKG

SEQ ID NO: 1289 - protein, 17 aa, Artificial Sequence
  Description of Artificial Sequence: Synthetic peptide
VIWYDASNENYADAVKG

SEQ ID NO: 1290 - protein, 17 aa, Artificial Sequence
  Description of Artificial Sequence: Synthetic peptide
VIWYDASNENYADAVKG

SEQ ID NO: 1291 - protein, 17 aa, Artificial Sequence
  Description of Artificial Sequence: Synthetic peptide
VIWYDASNENYADAVKG

SEQ ID NO: 1292 - protein, 17 aa, Artificial Sequence
  Description of Artificial Sequence: Synthetic peptide
VIWYDGSNENYADAVKG

SEQ ID NO: 1293 - protein, 17 aa, Artificial Sequence
  Description of Artificial Sequence: Synthetic peptide
VIWYDASNENYADSVKG

SEQ ID NO: 1294 - protein, 17 aa, Artificial Sequence
  Description of Artificial Sequence: Synthetic peptide
VIWYDASNENYADAVKG

SEQ ID NO: 1295 - protein, 17 aa, Artificial Sequence
  Description of Artificial Sequence: Synthetic peptide
VIWYDASNENYADAVKG

SEQ ID NO: 1296 - protein, 17 aa, Artificial Sequence
  Description of Artificial Sequence: Synthetic peptide
VIWYDASNKYYADAVKG

SEQ ID NO: 1297 - protein, 17 aa, Artificial Sequence
  Description of Artificial Sequence: Synthetic peptide
VIWYDASNKYYADAVKG

SEQ ID NO: 1298 - protein, 17 aa, Artificial Sequence
  Description of Artificial Sequence: Synthetic peptide
VIWYDASNKYYADAVKG

SEQ ID NO: 1299 - protein, 17 aa, Artificial Sequence
  Description of Artificial Sequence: Synthetic peptide
VIWYDASNKYYADAVKG

SEQ ID NO: 1300 - protein, 17 aa, Artificial Sequence
  Description of Artificial Sequence: Synthetic peptide
VIWYDASNKYYADAVKG

SEQ ID NO: 1301 - protein, 17 aa, Artificial Sequence
  Description of Artificial Sequence: Synthetic peptide
VIWYDASNKYYADAVKG

SEQ ID NO: 1302 - protein, 17 aa, Artificial Sequence
  Description of Artificial Sequence: Synthetic peptide
VIWYDASNKYYADAVKG

SEQ ID NO: 1303 - protein, 17 aa, Artificial Sequence
  Description of Artificial Sequence: Synthetic peptide
VIWYDASNKYYADSVKG

SEQ ID NO: 1304 - protein, 17 aa, Artificial Sequence
  Description of Artificial Sequence: Synthetic peptide
VIWYDGSNKYYADAVKG

SEQ ID NO: 1305 - protein, 17 aa, Artificial Sequence
  Description of Artificial Sequence: Synthetic peptide
VIWYDASNKYYADAVKG

SEQ ID NO: 1306 - protein, 17 aa, Artificial Sequence
  Description of Artificial Sequence: Synthetic peptide
VIWYDASNKYYADAVKG

SEQ ID NO: 1307 - protein, 17 aa, Artificial Sequence
  Description of Artificial Sequence: Synthetic peptide
VIWYDASNKYYADAVKG

SEQ ID NO: 1308 - protein, 17 aa, Artificial Sequence
  Description of Artificial Sequence: Synthetic peptide
VIWYDASNKYYADAVKG

SEQ ID NO: 1309 - protein, 17 aa, Artificial Sequence
  Description of Artificial Sequence: Synthetic peptide
VIWYDGSNKYYADSVKG

SEQ ID NO: 1310 - protein, 17 aa, Artificial Sequence
  Description of Artificial Sequence: Synthetic peptide
VIWYDASNKYYADSVKG

SEQ ID NO: 1311 - protein, 17 aa, Artificial Sequence
  Description of Artificial Sequence: Synthetic peptide
VIWYDGSNKYYADAVKG

SEQ ID NO: 1312 - protein, 17 aa, Artificial Sequence
  Description of Artificial Sequence: Synthetic peptide
AIWYDANNKYYADAVKG

SEQ ID NO: 1313 - protein, 17 aa, Artificial Sequence
  Description of Artificial Sequence: Synthetic peptide
AIWYDANNKYYADAVKG

SEQ ID NO: 1314 - protein, 17 aa, Artificial Sequence
  Description of Artificial Sequence: Synthetic peptide
AIWYDANNKYYADAVKG

SEQ ID NO: 1315 - protein, 17 aa, Artificial Sequence
  Description of Artificial Sequence: Synthetic peptide
AIWYDANNKYYADAVKG

SEQ ID NO: 1316 - protein, 17 aa, Artificial Sequence
  Description of Artificial Sequence: Synthetic peptide
AIWYDANNKYYADAVKG

SEQ ID NO: 1317 - protein, 17 aa, Artificial Sequence
  Description of Artificial Sequence: Synthetic peptide
AIWYDANNKYYADAVKG

SEQ ID NO: 1318 - protein, 17 aa, Artificial Sequence
  Description of Artificial Sequence: Synthetic peptide
AIWYDANNKYYADAVKG

SEQ ID NO: 1319 - protein, 17 aa, Artificial Sequence
  Description of Artificial Sequence: Synthetic peptide
AIWYDGNNKYYADAVKG

SEQ ID NO: 1320 - protein, 17 aa, Artificial Sequence
  Description of Artificial Sequence: Synthetic peptide
AIWYDANNKYYADSVKG

SEQ ID NO: 1321 - protein, 17 aa, Artificial Sequence
  Description of Artificial Sequence: Synthetic peptide
AIWYDANNKYYADAVKG

SEQ ID NO: 1322 - protein, 17 aa, Artificial Sequence
  Description of Artificial Sequence: Synthetic peptide
AIWYDANNKYYADAVKG

SEQ ID NO: 1323 - protein, 17 aa, Artificial Sequence
  Description of Artificial Sequence: Synthetic peptide
VIWYDASNKYYEDAVKG

SEQ ID NO: 1324 - protein, 17 aa, Artificial Sequence
  Description of Artificial Sequence: Synthetic peptide
VIWYDGSNKYYEDSVKG

SEQ ID NO: 1325 - protein, 17 aa, Artificial Sequence
  Description of Artificial Sequence: Synthetic peptide
VIWYDGSNKYYEDAVKG

SEQ ID NO: 1326 - protein, 17 aa, Artificial Sequence
  Description of Artificial Sequence: Synthetic peptide
VIWYDASNKYYEDSVKG

SEQ ID NO: 1327 - protein, 17 aa, Artificial Sequence
  Description of Artificial Sequence: Synthetic peptide
AIWFDASDKYYADAVKG

SEQ ID NO: 1328 - protein, 17 aa, Artificial Sequence
  Description of Artificial Sequence: Synthetic peptide
AIWFDASDKYYADSVKG

SEQ ID NO: 1329 - protein, 17 aa, Artificial Sequence
  Description of Artificial Sequence: Synthetic peptide
AIWFDGSDKYYADAVKG

SEQ ID NO: 1330 - protein, 17 aa, Artificial Sequence
  Description of Artificial Sequence: Synthetic peptide
AIWFDASDKYYADAVKG

SEQ ID NO: 1331 - protein, 17 aa, Artificial Sequence
  Description of Artificial Sequence: Synthetic peptide
AIWFDASDKYYADAVKG

SEQ ID NO: 1332 - protein, 17 aa, Artificial Sequence
  Description of Artificial Sequence: Synthetic peptide
AIWFDASDKYYADAVKG

SEQ ID NO: 1333 - protein, 17 aa, Artificial Sequence
  Description of Artificial Sequence: Synthetic peptide
AIWFDASDKYYADAVKG

SEQ ID NO: 1334 - protein, 17 aa, Artificial Sequence
  Description of Artificial Sequence: Synthetic peptide
AIWFDASDKYYADAVKG

SEQ ID NO: 1335 - protein, 16 aa, Artificial Sequence
  Description of Artificial Sequence: Synthetic peptide
YIYYSGSTYYNPSLKS

SEQ ID NO: 1336 - protein, 16 aa, Artificial Sequence
  Description of Artificial Sequence: Synthetic peptide
YIYYSGSTYYNPSLKS

SEQ ID NO: 1337 - protein, 16 aa, Artificial Sequence
  Description of Artificial Sequence: Synthetic peptide
YIYYSGSTYYNPSLKS

SEQ ID NO: 1338 - protein, 16 aa, Artificial Sequence
  Description of Artificial Sequence: Synthetic peptide
YIYYSGSTYYNPSLKS

SEQ ID NO: 1339 - protein, 16 aa, Artificial Sequence
  Description of Artificial Sequence: Synthetic peptide
YIYYSGSTYYNPSLKS

SEQ ID NO: 1340 - protein, 16 aa, Artificial Sequence
  Description of Artificial Sequence: Synthetic peptide
YIYYSGSTYYNPSLKS

SEQ ID NO: 1341 - protein, 16 aa, Artificial Sequence
  Description of Artificial Sequence: Synthetic peptide
YIYYSGSTYYNPSLKS

SEQ ID NO: 1342 - protein, 17 aa, Artificial Sequence
  Description of Artificial Sequence: Synthetic peptide
WINPESGGTDYSQRFQG

SEQ ID NO: 1343 - protein, 17 aa, Artificial Sequence
  Description of Artificial Sequence: Synthetic peptide
WINPESGGTDYSQRFQG

SEQ ID NO: 1344 - protein, 17 aa, Artificial Sequence
  Description of Artificial Sequence: Synthetic peptide
WINPDAGGTDYSQRFQG

SEQ ID NO: 1345 - protein, 17 aa, Artificial Sequence
  Description of Artificial Sequence: Synthetic peptide
WINPDAGGTDYSQRFQG

SEQ ID NO: 1346 - protein, 17 aa, Artificial Sequence
  Description of Artificial Sequence: Synthetic peptide
WINPDSGGTDYSQRFQG

SEQ ID NO: 1347 - protein, 17 aa, Artificial Sequence
  Description of Artificial Sequence: Synthetic peptide
WINPDSGGTDYSQRFQG

SEQ ID NO: 1348 - protein, 17 aa, Artificial Sequence
  Description of Artificial Sequence: Synthetic peptide
WINPDSGGTDYSQRFQG

SEQ ID NO: 1349 - protein, 17 aa, Artificial Sequence
  Description of Artificial Sequence: Synthetic peptide
WINPDAGGTDYSQRFQG

SEQ ID NO: 1350 - protein, 17 aa, Artificial Sequence
  Description of Artificial Sequence: Synthetic peptide
WINPDAGGTDYSQRFQG

SEQ ID NO: 1351 - protein, 17 aa, Artificial Sequence
  Description of Artificial Sequence: Synthetic peptide
WINPDAGGTDYSQRFQG

SEQ ID NO: 1352 - protein, 17 aa, Artificial Sequence
  Description of Artificial Sequence: Synthetic peptide
WINPESGGTDYSQRFQG

SEQ ID NO: 1353 - protein, 17 aa, Artificial Sequence
  Description of Artificial Sequence: Synthetic peptide
WISPNSGETSYAQKFQD

SEQ ID NO: 1354 - protein, 17 aa, Artificial Sequence
  Description of Artificial Sequence: Synthetic peptide
WISPNSGDTSYAQKFQD

SEQ ID NO: 1355 - protein, 17 aa, Artificial Sequence
  Description of Artificial Sequence: Synthetic peptide
WISPNSGETSYAQKFQD

SEQ ID NO: 1356 - protein, 17 aa, Artificial Sequence
  Description of Artificial Sequence: Synthetic peptide
WISPNSGETSYAQKFQD

SEQ ID NO: 1357 - protein, 17 aa, Artificial Sequence
  Description of Artificial Sequence: Synthetic peptide
WISPNSGDTSYAQKFQD

SEQ ID NO: 1358 - protein, 17 aa, Artificial Sequence
  Description of Artificial Sequence: Synthetic peptide
WISPNSGETSYAQKFQD

SEQ ID NO: 1359 - protein, 17 aa, Artificial Sequence
  Description of Artificial Sequence: Synthetic peptide
WISPNSGDTSYAQKFQD

SEQ ID NO: 1360 - protein, 17 aa, Artificial Sequence
  Description of Artificial Sequence: Synthetic peptide
WISPNSGETSYAQKFQD

SEQ ID NO: 1361 - protein, 17 aa, Artificial Sequence
  Description of Artificial Sequence: Synthetic peptide
WISPNSGETSYAQKFQD

SEQ ID NO: 1362 - protein, 17 aa, Artificial Sequence
  Description of Artificial Sequence: Synthetic peptide
WINPESGGTDYSQRFQG

SEQ ID NO: 1363 - protein, 17 aa, Artificial Sequence
  Description of Artificial Sequence: Synthetic peptide
WINPESGGTDYSQRFQG

SEQ ID NO: 1364 - protein, 17 aa, Artificial Sequence
  Description of Artificial Sequence: Synthetic peptide
WINPDSGGTDYSQRFQG

SEQ ID NO: 1365 - protein, 17 aa, Artificial Sequence
  Description of Artificial Sequence: Synthetic peptide
WINPESGGTDYSQRFQG

SEQ ID NO: 1366 - protein, 17 aa, Artificial Sequence
  Description of Artificial Sequence: Synthetic peptide
WINPESGGTDYSQRFQG

SEQ ID NO: 1367 - protein, 17 aa, Artificial Sequence
  Description of Artificial Sequence: Synthetic peptide
WISPNQGETNYAQKFQD

SEQ ID NO: 1368 - protein, 17 aa, Artificial Sequence
  Description of Artificial Sequence: Synthetic peptide
WISPNQGDTNYAQKFQD

SEQ ID NO: 1369 - protein, 17 aa, Artificial Sequence
  Description of Artificial Sequence: Synthetic peptide
WISPNQGETNYAQKFQD

SEQ ID NO: 1370 - protein, 17 aa, Artificial Sequence
  Description of Artificial Sequence: Synthetic peptide
WISPNNGETNYAQKFQD

SEQ ID NO: 1371 - protein, 17 aa, Artificial Sequence
  Description of Artificial Sequence: Synthetic peptide
WISPNNGDTNYAQKFQD

SEQ ID NO: 1372 - protein, 17 aa, Artificial Sequence
  Description of Artificial Sequence: Synthetic peptide
WISPNQGDTNYAQKFQD

SEQ ID NO: 1373 - protein, 17 aa, Artificial Sequence
  Description of Artificial Sequence: Synthetic peptide
WISPNNGETNYAQKFQD

SEQ ID NO: 1374 - protein, 17 aa, Artificial Sequence
  Description of Artificial Sequence: Synthetic peptide
WISPNQGETNYAQKFQD

SEQ ID NO: 1375 - protein, 17 aa, Artificial Sequence
  Description of Artificial Sequence: Synthetic peptide
WISPNNGDTNYAQKFQD

SEQ ID NO: 1376 - protein, 17 aa, Artificial Sequence
  Description of Artificial Sequence: Synthetic peptide
WISPNQGDTNYAQKFQD

SEQ ID NO: 1377 - protein, 17 aa, Artificial Sequence
  Description of Artificial Sequence: Synthetic peptide
WISPNNGETNYAQKFQD

SEQ ID NO: 1378 - protein, 17 aa, Artificial Sequence
  Description of Artificial Sequence: Synthetic peptide
WISPNQGETNYAQKFQD

SEQ ID NO: 1379 - protein, 17 aa, Artificial Sequence
  Description of Artificial Sequence: Synthetic peptide
WISPNQGETNYAQKFQD

SEQ ID NO: 1380 - protein, 17 aa, Artificial Sequence
  Description of Artificial Sequence: Synthetic peptide
WINPNSGGTNYAQKFQG

SEQ ID NO: 1381 - protein, 17 aa, Artificial Sequence
  Description of Artificial Sequence: Synthetic peptide
WINPNSGGTNYAQKFQG

SEQ ID NO: 1382 - protein, 17 aa, Artificial Sequence
  Description of Artificial Sequence: Synthetic peptide
WINPNSGGTNYAQKFQG

SEQ ID NO: 1383 - protein, 17 aa, Artificial Sequence
  Description of Artificial Sequence: Synthetic peptide
WINPNSGGTNYAQKFQG

SEQ ID NO: 1384 - protein, 17 aa, Artificial Sequence
  Description of Artificial Sequence: Synthetic peptide
WINPNSGGTNYAQKFQG

SEQ ID NO: 1385 - protein, 17 aa, Artificial Sequence
  Description of Artificial Sequence: Synthetic peptide
WINPNSGGTNYAQKFQG

SEQ ID NO: 1386 - protein, 17 aa, Artificial Sequence
  Description of Artificial Sequence: Synthetic peptide
WINPNSGGTNYAQKFQG

SEQ ID NO: 1387 - protein, 17 aa, Artificial Sequence
  Description of Artificial Sequence: Synthetic peptide
WINPNSGGTNYAQKFQG

SEQ ID NO: 1388 - protein, 17 aa, Artificial Sequence
  Description of Artificial Sequence: Synthetic peptide
WINPNSGGTNYAQKFQG

SEQ ID NO: 1389 - protein, 17 aa, Artificial Sequence
  Description of Artificial Sequence: Synthetic peptide
WINPNSGGTNYAQKFQG

SEQ ID NO: 1390 - protein, 17 aa, Artificial Sequence
  Description of Artificial Sequence: Synthetic peptide
WINPNSGGTNYAQKFQG

SEQ ID NO: 1391 - protein, 17 aa, Artificial Sequence
  Description of Artificial Sequence: Synthetic peptide
WINPNSGGTNYAQKFQG

SEQ ID NO: 1392 - protein, 17 aa, Artificial Sequence
  Description of Artificial Sequence: Synthetic peptide
WINPNSGGTNYAQKFQG

SEQ ID NO: 1393 - protein, 17 aa, Artificial Sequence
  Description of Artificial Sequence: Synthetic peptide
WINPNSGGTNYAQKFQG

SEQ ID NO: 1394 - protein, 17 aa, Artificial Sequence
  Description of Artificial Sequence: Synthetic peptide
VIWYDASNENYADAVKG

SEQ ID NO: 1395 - protein, 17 aa, Artificial Sequence
  Description of Artificial Sequence: Synthetic peptide
VIWYDASNKYYADAVKG

SEQ ID NO: 1396 - protein, 17 aa, Artificial Sequence
  Description of Artificial Sequence: Synthetic peptide
WINPNSGGTNYAQKFQG

SEQ ID NO: 1397 - protein, 17 aa, Artificial Sequence
  Description of Artificial Sequence: Synthetic peptide
VIWYDGSNKFHADSVKG

SEQ ID NO: 1398 - protein, 17 aa, Artificial Sequence
  Description of Artificial Sequence: Synthetic peptide
WMNPNSGNTGYAQKFQG

SEQ ID NO: 1399 - protein, 17 aa, Artificial Sequence
  Description of Artificial Sequence: Synthetic peptide
VIWYDASNKFHADAVKG

SEQ ID NO: 1400 - protein, 17 aa, Artificial Sequence
  Description of Artificial Sequence: Synthetic peptide
VIWYDASNKFHADAVKG

SEQ ID NO: 1401 - protein, 17 aa, Artificial Sequence
  Description of Artificial Sequence: Synthetic peptide
VIWYDASNKFHADAVKG

SEQ ID NO: 1402 - protein, 17 aa, Artificial Sequence
  Description of Artificial Sequence: Synthetic peptide
VIWYDASNKFHADAVKG

SEQ ID NO: 1403 - protein, 17 aa, Artificial Sequence
  Description of Artificial Sequence: Synthetic peptide
VIWYDASNKFHADSVKG

SEQ ID NO: 1404 - protein, 17 aa, Artificial Sequence
  Description of Artificial Sequence: Synthetic peptide
VIWYDGSNKFHADAVKG

SEQ ID NO: 1405 - protein, 17 aa, Artificial Sequence
  Description of Artificial Sequence: Synthetic peptide
WMNPNSGGTGYAQKFQG

SEQ ID NO: 1406 - protein, 17 aa, Artificial Sequence
  Description of Artificial Sequence: Synthetic peptide
WMNPNSGNTGYAQKFQG

SEQ ID NO: 1407 - protein, 17 aa, Artificial Sequence
  Description of Artificial Sequence: Synthetic peptide
WMNPNSGGTGYAQKFQG

SEQ ID NO: 1408 - protein, 17 aa, Artificial Sequence
  Description of Artificial Sequence: Synthetic peptide
WMNPNSGGTGYAQKFQG

SEQ ID NO: 1409 - protein, 17 aa, Artificial Sequence
  Description of Artificial Sequence: Synthetic peptide
WMNPNSGGTGYAQKFQG

SEQ ID NO: 1410 - protein, 17 aa, Artificial Sequence
  Description of Artificial Sequence: Synthetic peptide
WMNPNSGNTGYAQKFQG

SEQ ID NO: 1411 - protein, 17 aa, Artificial Sequence
  Description of Artificial Sequence: Synthetic peptide
WMNPNSGGTGYAQKFQG

SEQ ID NO: 1412 - protein, 17 aa, Artificial Sequence
  Description of Artificial Sequence: Synthetic peptide
WMNPNSGGTGYAQKFQG

SEQ ID NO: 1413 - protein, 17 aa, Artificial Sequence
  Description of Artificial Sequence: Synthetic peptide
VIWYDASNKFHADAVKG

SEQ ID NO: 1414 - protein, 19 aa, Artificial Sequence
  Description of Artificial Sequence: Synthetic peptide
GGDYVWGTYRPHYYYGMDV

SEQ ID NO: 1415 - protein, 12 aa, Artificial Sequence
  Description of Artificial Sequence: Synthetic peptide
DGTIFGVVLGDY

SEQ ID NO: 1416 - protein, 12 aa, Artificial Sequence
  Description of Artificial Sequence: Synthetic peptide
DGTIFGVLLGDY

SEQ ID NO: 1417 - protein, 11 aa, Artificial Sequence
  Description of Artificial Sequence: Synthetic peptide
DRTIFGVVLDY

SEQ ID NO: 1418 - protein, 14 aa, Artificial Sequence
  Description of Artificial Sequence: Synthetic peptide
EATIFGMVIVPFDY

SEQ ID NO: 1419 - protein, 14 aa, Artificial Sequence
  Description of Artificial Sequence: Synthetic peptide
EATIFGMVIVPFDY

SEQ ID NO: 1420 - protein, 14 aa, Artificial Sequence
  Description of Artificial Sequence: Synthetic peptide
EATIFGMLIVPFDY

SEQ ID NO: 1421 - protein, 14 aa, Artificial Sequence
  Description of Artificial Sequence: Synthetic peptide
EATIFGMLIVPFDY

SEQ ID NO: 1422 - protein, 16 aa, Artificial Sequence
  Description of Artificial Sequence: Synthetic peptide
DRITIFGVVMGGGMDV

SEQ ID NO: 1423 - protein, 11 aa, Artificial Sequence
  Description of Artificial Sequence: Synthetic peptide
DQAIFGVVPDY

SEQ ID NO: 1424 - protein, 12 aa, Artificial Sequence
  Description of Artificial Sequence: Synthetic peptide
DGTIFGVLLGDY

SEQ ID NO: 1425 - protein, 11 aa, Artificial Sequence
  Description of Artificial Sequence: Synthetic peptide
DRTIFGVVLEY

SEQ ID NO: 1426 - protein, 9 aa, Artificial Sequence
  Description of Artificial Sequence: Synthetic peptide
DVAVAGFDY

SEQ ID NO: 1427 - protein, 9 aa, Artificial Sequence
  Description of Artificial Sequence: Synthetic peptide
DVAVAGFDY

SEQ ID NO: 1428 - protein, 12 aa, Artificial Sequence
  Description of Artificial Sequence: Synthetic peptide
DGTIFGVLLGDY

SEQ ID NO: 1429 - protein, 12 aa, Artificial Sequence
  Description of Artificial Sequence: Synthetic peptide
DGTIFGVLLGDY

SEQ ID NO: 1430 - protein, 12 aa, Artificial Sequence
  Description of Artificial Sequence: Synthetic peptide
DGTIFGVLLGDY

SEQ ID NO: 1431 - protein, 12 aa, Artificial Sequence
  Description of Artificial Sequence: Synthetic peptide
DGTIFGVLLGDY

SEQ ID NO: 1432 - protein, 12 aa, Artificial Sequence
  Description of Artificial Sequence: Synthetic peptide
DGTIFGVLLGDY

SEQ ID NO: 1433 - protein, 12 aa, Artificial Sequence
  Description of Artificial Sequence: Synthetic peptide
DRTIFGVLLGDY

SEQ ID NO: 1434 - protein, 12 aa, Artificial Sequence
  Description of Artificial Sequence: Synthetic peptide
DGTIFGVVLGDY

SEQ ID NO: 1435 - protein, 12 aa, Artificial Sequence
  Description of Artificial Sequence: Synthetic peptide
DGTIFGVVLGDY

SEQ ID NO: 1436 - protein, 12 aa, Artificial Sequence
  Description of Artificial Sequence: Synthetic peptide
DGTIFGVVLGDY

SEQ ID NO: 1437 - protein, 12 aa, Artificial Sequence
  Description of Artificial Sequence: Synthetic peptide
DGTIFGVVLGDY

SEQ ID NO: 1438 - protein, 12 aa, Artificial Sequence
  Description of Artificial Sequence: Synthetic peptide
DGTIFGVVLGDY

SEQ ID NO: 1439 - protein, 12 aa, Artificial Sequence
  Description of Artificial Sequence: Synthetic peptide
DRTIFGVVLGDY

SEQ ID NO: 1440 - protein, 12 aa, Artificial Sequence
  Description of Artificial Sequence: Synthetic peptide
DGTIFGVVLGDY

SEQ ID NO: 1441 - protein, 12 aa, Artificial Sequence
  Description of Artificial Sequence: Synthetic peptide
DGTIFGVVLGDY

SEQ ID NO: 1442 - protein, 12 aa, Artificial Sequence
  Description of Artificial Sequence: Synthetic peptide
DGTIFGVVLGDY

SEQ ID NO: 1443 - protein, 12 aa, Artificial Sequence
  Description of Artificial Sequence: Synthetic peptide
DGTIFGVVLGDY

SEQ ID NO: 1444 - protein, 12 aa, Artificial Sequence
  Description of Artificial Sequence: Synthetic peptide
DGTIFGVVLGDY

SEQ ID NO: 1445 - protein, 12 aa, Artificial Sequence
  Description of Artificial Sequence: Synthetic peptide
DGTIFGVVLGDY

SEQ ID NO: 1446 - protein, 12 aa, Artificial Sequence
  Description of Artificial Sequence: Synthetic peptide
DGTIFGVVLGDY

SEQ ID NO: 1447 - protein, 12 aa, Artificial Sequence
  Description of Artificial Sequence: Synthetic peptide
DGTIFGVVLGDY

SEQ ID NO: 1448 - protein, 12 aa, Artificial Sequence
  Description of Artificial Sequence: Synthetic peptide
DGTIFGVVLGDY

SEQ ID NO: 1449 - protein, 12 aa, Artificial Sequence
  Description of Artificial Sequence: Synthetic peptide
DGTIFGVVLGDY

SEQ ID NO: 1450 - protein, 12 aa, Artificial Sequence
  Description of Artificial Sequence: Synthetic peptide
DGTIFGVVLGDY

SEQ ID NO: 1451 - protein, 12 aa, Artificial Sequence
  Description of Artificial Sequence: Synthetic peptide
DRTIFGVVLGDY

SEQ ID NO: 1452 - protein, 12 aa, Artificial Sequence
  Description of Artificial Sequence: Synthetic peptide
DGTIFGVVLGDY

SEQ ID NO: 1453 - protein, 11 aa, Artificial Sequence
  Description of Artificial Sequence: Synthetic peptide
DRTIFGVVLDY

SEQ ID NO: 1454 - protein, 11 aa, Artificial Sequence
  Description of Artificial Sequence: Synthetic peptide
DRTIFGVVLDY

SEQ ID NO: 1455 - protein, 11 aa, Artificial Sequence
  Description of Artificial Sequence: Synthetic peptide
DRTIFGVVLDY

SEQ ID NO: 1456 - protein, 11 aa, Artificial Sequence
  Description of Artificial Sequence: Synthetic peptide
DRTIFGVVLDY

SEQ ID NO: 1457 - protein, 11 aa, Artificial Sequence
  Description of Artificial Sequence: Synthetic peptide
DRTIFGVVLDY

SEQ ID NO: 1458 - protein, 11 aa, Artificial Sequence
  Description of Artificial Sequence: Synthetic peptide
DRTIFGVVLDY

SEQ ID NO: 1459 - protein, 11 aa, Artificial Sequence
  Description of Artificial Sequence: Synthetic peptide
DRTIFGVVLDY

SEQ ID NO: 1460 - protein, 11 aa, Artificial Sequence
  Description of Artificial Sequence: Synthetic peptide
DRTIFGVVLDY

SEQ ID NO: 1461 - protein, 11 aa, Artificial Sequence
  Description of Artificial Sequence: Synthetic peptide
DRTIFGVVLDY

SEQ ID NO: 1462 - protein, 12 aa, Artificial Sequence
  Description of Artificial Sequence: Synthetic peptide
DGTIFGVLLGDY

SEQ ID NO: 1463 - protein, 12 aa, Artificial Sequence
  Description of Artificial Sequence: Synthetic peptide
DRTIFGVLLGDY

SEQ ID NO: 1464 - protein, 12 aa, Artificial Sequence
  Description of Artificial Sequence: Synthetic peptide
DGTIFGVLLGDY

SEQ ID NO: 1465 - protein, 12 aa, Artificial Sequence
  Description of Artificial Sequence: Synthetic peptide
DRTIFGVLLGDY

SEQ ID NO: 1466 - protein, 12 aa, Artificial Sequence
  Description of Artificial Sequence: Synthetic peptide
DGTIFGVLLGDY

SEQ ID NO: 1467 - protein, 12 aa, Artificial Sequence
  Description of Artificial Sequence: Synthetic peptide
DGTIFGVLLGDY

SEQ ID NO: 1468 - protein, 12 aa, Artificial Sequence
  Description of Artificial Sequence: Synthetic peptide
DGTIFGVLLGDY

SEQ ID NO: 1469 - protein, 11 aa, Artificial Sequence
  Description of Artificial Sequence: Synthetic peptide
DRTIFGVVLEY

SEQ ID NO: 1470 - protein, 11 aa, Artificial Sequence
  Description of Artificial Sequence: Synthetic peptide
DRTIFGVVLEY

SEQ ID NO: 1471 - protein, 11 aa, Artificial Sequence
  Description of Artificial Sequence: Synthetic peptide
DRTIFGVVLEY

SEQ ID NO: 1472 - protein, 11 aa, Artificial Sequence
  Description of Artificial Sequence: Synthetic peptide
DRTIFGVVLEY

SEQ ID NO: 1473 - protein, 11 aa, Artificial Sequence
  Description of Artificial Sequence: Synthetic peptide
DRTIFGVVLEY

SEQ ID NO: 1474 - protein, 11 aa, Artificial Sequence
  Description of Artificial Sequence: Synthetic peptide
DRTIFGVVLEY

SEQ ID NO: 1475 - protein, 11 aa, Artificial Sequence
  Description of Artificial Sequence: Synthetic peptide
DRTIFGVVLEY

SEQ ID NO: 1476 - protein, 11 aa, Artificial Sequence
  Description of Artificial Sequence: Synthetic peptide
DRTIFGVVLEY

SEQ ID NO: 1477 - protein, 11 aa, Artificial Sequence
  Description of Artificial Sequence: Synthetic peptide
DRTIFGVVLEY

SEQ ID NO: 1478 - protein, 11 aa, Artificial Sequence
  Description of Artificial Sequence: Synthetic peptide
DRTIFGVVLEY

SEQ ID NO: 1479 - protein, 11 aa, Artificial Sequence
  Description of Artificial Sequence: Synthetic peptide
DRTIFGVVLEY

SEQ ID NO: 1480 - protein, 11 aa, Artificial Sequence
  Description of Artificial Sequence: Synthetic peptide
GITIFGHGFEY

SEQ ID NO: 1481 - protein, 11 aa, Artificial Sequence
  Description of Artificial Sequence: Synthetic peptide
GITIFGHGFEY

SEQ ID NO: 1482 - protein, 11 aa, Artificial Sequence
  Description of Artificial Sequence: Synthetic peptide
GITIFGHGFEY

SEQ ID NO: 1483 - protein, 11 aa, Artificial Sequence
  Description of Artificial Sequence: Synthetic peptide
GITIFGHGFEY

SEQ ID NO: 1484 - protein, 11 aa, Artificial Sequence
  Description of Artificial Sequence: Synthetic peptide
DQAIFGVVPDY

SEQ ID NO: 1485 - protein, 11 aa, Artificial Sequence
  Description of Artificial Sequence: Synthetic peptide
DQAIFGVVPDY

SEQ ID NO: 1486 - protein, 11 aa, Artificial Sequence
  Description of Artificial Sequence: Synthetic peptide
DQAIFGVVPDY

SEQ ID NO: 1487 - protein, 11 aa, Artificial Sequence
  Description of Artificial Sequence: Synthetic peptide
DQAIFGVVPDY

SEQ ID NO: 1488 - protein, 11 aa, Artificial Sequence
  Description of Artificial Sequence: Synthetic peptide
DQAIFGVVPDY

SEQ ID NO: 1489 - protein, 11 aa, Artificial Sequence
  Description of Artificial Sequence: Synthetic peptide
DQAIFGVVPDY

SEQ ID NO: 1490 - protein, 11 aa, Artificial Sequence
  Description of Artificial Sequence: Synthetic peptide
DQAIFGVVPDY

SEQ ID NO: 1491 - protein, 11 aa, Artificial Sequence
  Description of Artificial Sequence: Synthetic peptide
DQAIFGVVPDY

SEQ ID NO: 1492 - protein, 16 aa, Artificial Sequence
  Description of Artificial Sequence: Synthetic peptide
DRITIFGVVMGGGMDV

SEQ ID NO: 1493 - protein, 16 aa, Artificial Sequence
  Description of Artificial Sequence: Synthetic peptide
DRITIFGVVMGGGMDV

SEQ ID NO: 1494 - protein, 16 aa, Artificial Sequence
  Description of Artificial Sequence: Synthetic peptide
DRITIFGVVMGGGMDV

SEQ ID NO: 1495 - protein, 16 aa, Artificial Sequence
  Description of Artificial Sequence: Synthetic peptide
DRITIFGVVMGGGMDV

SEQ ID NO: 1496 - protein, 16 aa, Artificial Sequence
  Description of Artificial Sequence: Synthetic peptide
DRITIFGVVMGGGMDV

SEQ ID NO: 1497 - protein, 16 aa, Artificial Sequence
  Description of Artificial Sequence: Synthetic peptide
DRITIFGVVMGGGMDV

SEQ ID NO: 1498 - protein, 16 aa, Artificial Sequence
  Description of Artificial Sequence: Synthetic peptide
DRITIFGVVMGGGMDV

SEQ ID NO: 1499 - protein, 14 aa, Artificial Sequence
  Description of Artificial Sequence: Synthetic peptide
EATIFGMVIVPFDY

SEQ ID NO: 1500 - protein, 14 aa, Artificial Sequence
  Description of Artificial Sequence: Synthetic peptide
EATIFGMVIVPFDY

SEQ ID NO: 1501 - protein, 14 aa, Artificial Sequence
  Description of Artificial Sequence: Synthetic peptide
EATIFGMVIVPFDY

SEQ ID NO: 1502 - protein, 14 aa, Artificial Sequence
  Description of Artificial Sequence: Synthetic peptide
EATIFGMVIVPFDY

SEQ ID NO: 1503 - protein, 14 aa, Artificial Sequence
  Description of Artificial Sequence: Synthetic peptide
EATIFGMVIVPFDY

SEQ ID NO: 1504 - protein, 14 aa, Artificial Sequence
  Description of Artificial Sequence: Synthetic peptide
EATIFGMVIVPFDY

SEQ ID NO: 1505 - protein, 14 aa, Artificial Sequence
  Description of Artificial Sequence: Synthetic peptide
EATIFGMVIVPFDY

SEQ ID NO: 1506 - protein, 14 aa, Artificial Sequence
  Description of Artificial Sequence: Synthetic peptide
EATIFGMVIVPFDY

SEQ ID NO: 1507 - protein, 14 aa, Artificial Sequence
  Description of Artificial Sequence: Synthetic peptide
EATIFGMVIVPFDY

SEQ ID NO: 1508 - protein, 14 aa, Artificial Sequence
  Description of Artificial Sequence: Synthetic peptide
EATIFGMVIVPFDY

SEQ ID NO: 1509 - protein, 14 aa, Artificial Sequence
  Description of Artificial Sequence: Synthetic peptide
EATIFGMVIVPFDY

SEQ ID NO: 1510 - protein, 14 aa, Artificial Sequence
  Description of Artificial Sequence: Synthetic peptide
EATIFGMLIVPFDY

SEQ ID NO: 1511 - protein, 14 aa, Artificial Sequence
  Description of Artificial Sequence: Synthetic peptide
EATIFGMLIVPFDY

SEQ ID NO: 1512 - protein, 14 aa, Artificial Sequence
  Description of Artificial Sequence: Synthetic peptide
EATIFGMLIVPFDY

SEQ ID NO: 1513 - protein, 14 aa, Artificial Sequence
  Description of Artificial Sequence: Synthetic peptide
EATIFGMLIVPFDY

SEQ ID NO: 1514 - protein, 14 aa, Artificial Sequence
  Description of Artificial Sequence: Synthetic peptide
EATIFGMLIVPFDY

SEQ ID NO: 1515 - protein, 14 aa, Artificial Sequence
  Description of Artificial Sequence: Synthetic peptide
EATIFGMLIVPFDY

SEQ ID NO: 1516 - protein, 14 aa, Artificial Sequence
  Description of Artificial Sequence: Synthetic peptide
EATIFGMLIVPFDY

SEQ ID NO: 1517 - protein, 14 aa, Artificial Sequence
  Description of Artificial Sequence: Synthetic peptide
EATIFGMLIVPFDY

SEQ ID NO: 1518 - protein, 14 aa, Artificial Sequence
  Description of Artificial Sequence: Synthetic peptide
EATIFGMLIVPFDY

SEQ ID NO: 1519 - protein, 14 aa, Artificial Sequence
  Description of Artificial Sequence: Synthetic peptide
EATIFGMVIVPFDY

SEQ ID NO: 1520 - protein, 14 aa, Artificial Sequence
  Description of Artificial Sequence: Synthetic peptide
EATIFGMVIVPFDY

SEQ ID NO: 1521 - protein, 14 aa, Artificial Sequence
  Description of Artificial Sequence: Synthetic peptide
EATIFGMVIVPFDY

SEQ ID NO: 1522 - protein, 14 aa, Artificial Sequence
  Description of Artificial Sequence: Synthetic peptide
EATIFGMVIVPFDY

SEQ ID NO: 1523 - protein, 14 aa, Artificial Sequence
  Description of Artificial Sequence: Synthetic peptide
EATIFGMVIVPFDY

SEQ ID NO: 1524 - protein, 14 aa, Artificial Sequence
  Description of Artificial Sequence: Synthetic peptide
EATIFGMLIVPFDY

SEQ ID NO: 1525 - protein, 14 aa, Artificial Sequence
  Description of Artificial Sequence: Synthetic peptide
EATIFGMLIVPFDY

SEQ ID NO: 1526 - protein, 14 aa, Artificial Sequence
  Description of Artificial Sequence: Synthetic peptide
EATIFGMLIVPFDY

SEQ ID NO: 1527 - protein, 14 aa, Artificial Sequence
  Description of Artificial Sequence: Synthetic peptide
EATIFGMLIVPFDY

SEQ ID NO: 1528 - protein, 14 aa, Artificial Sequence
  Description of Artificial Sequence: Synthetic peptide
EATIFGMLIVPFDY

SEQ ID NO: 1529 - protein, 14 aa, Artificial Sequence
  Description of Artificial Sequence: Synthetic peptide
EATIFGMLIVPFDY

SEQ ID NO: 1530 - protein, 14 aa, Artificial Sequence
  Description of Artificial Sequence: Synthetic peptide
EATIFGMLIVPFDY

SEQ ID NO: 1531 - protein, 14 aa, Artificial Sequence
  Description of Artificial Sequence: Synthetic peptide
EATIFGMLIVPFDY

SEQ ID NO: 1532 - protein, 14 aa, Artificial Sequence
  Description of Artificial Sequence: Synthetic peptide
EATIFGMLIVPFDY

SEQ ID NO: 1533 - protein, 14 aa, Artificial Sequence
  Description of Artificial Sequence: Synthetic peptide
EATIFGMLIVPFDY

SEQ ID NO: 1534 - protein, 14 aa, Artificial Sequence
  Description of Artificial Sequence: Synthetic peptide
EATIFGMLIVPFDY

SEQ ID NO: 1535 - protein, 14 aa, Artificial Sequence
  Description of Artificial Sequence: Synthetic peptide
EATIFGMLIVPFDY

SEQ ID NO: 1536 - protein, 14 aa, Artificial Sequence
  Description of Artificial Sequence: Synthetic peptide
EATIFGMLIVPFDY

SEQ ID NO: 1537 - protein, 19 aa, Artificial Sequence
  Description of Artificial Sequence: Synthetic peptide
GGDYVWGTYRPHYYYGMDV

SEQ ID NO: 1538 - protein, 19 aa, Artificial Sequence
  Description of Artificial Sequence: Synthetic peptide
GGDYVWGTYRPHYYYGMDV

SEQ ID NO: 1539 - protein, 19 aa, Artificial Sequence
  Description of Artificial Sequence: Synthetic peptide
GGDYVWGTYRPHYYYGMDV

SEQ ID NO: 1540 - protein, 19 aa, Artificial Sequence
  Description of Artificial Sequence: Synthetic peptide
GGDYVWGTYRPHYYYGMDV

SEQ ID NO: 1541 - protein, 19 aa, Artificial Sequence
  Description of Artificial Sequence: Synthetic peptide
GGDYVWGTYRPHYYYGMDV

SEQ ID NO: 1542 - protein, 19 aa, Artificial Sequence
  Description of Artificial Sequence: Synthetic peptide
GGDYVWGTYRPHYYYGMDV

SEQ ID NO: 1543 - protein, 19 aa, Artificial Sequence
  Description of Artificial Sequence: Synthetic peptide
GGDYVWGTYRPHYYYGMDV

SEQ ID NO: 1544 - protein, 19 aa, Artificial Sequence
  Description of Artificial Sequence: Synthetic peptide
GGDYVWGTYRPHYYYGMDV

SEQ ID NO: 1545 - protein, 19 aa, Artificial Sequence
  Description of Artificial Sequence: Synthetic peptide
GGDYVWGTYRPHYYYGMDV

SEQ ID NO: 1546 - protein, 19 aa, Artificial Sequence
  Description of Artificial Sequence: Synthetic peptide
GGDYVWGTYRPHYYYGMDV

SEQ ID NO: 1547 - protein, 19 aa, Artificial Sequence
  Description of Artificial Sequence: Synthetic peptide
GGDYVWGTYRPHYYYGMDV

SEQ ID NO: 1548 - protein, 19 aa, Artificial Sequence
  Description of Artificial Sequence: Synthetic peptide
GGDYVWGTYRPHYYYGMDV

SEQ ID NO: 1549 - protein, 19 aa, Artificial Sequence
  Description of Artificial Sequence: Synthetic peptide
GGDYVFGTYRPHYYYGMDV

SEQ ID NO: 1550 - protein, 19 aa, Artificial Sequence
  Description of Artificial Sequence: Synthetic peptide
GGDYVFGTYRPHYYYGMDV

SEQ ID NO: 1551 - protein, 12 aa, Artificial Sequence
  Description of Artificial Sequence: Synthetic peptide
DRTIFGVVLGDY

SEQ ID NO: 1552 - protein, 12 aa, Artificial Sequence
  Description of Artificial Sequence: Synthetic peptide
DRTIFGVLLGDY

SEQ ID NO: 1553 - protein, 19 aa, Artificial Sequence
  Description of Artificial Sequence: Synthetic peptide
GGDYVWGTYRPHYYYGMDV

SEQ ID NO: 1554 - protein, 12 aa, Artificial Sequence
  Description of Artificial Sequence: Synthetic peptide
GKVAGMPEAFEI

SEQ ID NO: 1555 - protein, 20 aa, Artificial Sequence
  Description of Artificial Sequence: Synthetic peptide
GGDYVWGSYRPYYYYYGMDV

SEQ ID NO: 1556 - protein, 12 aa, Artificial Sequence
  Description of Artificial Sequence: Synthetic peptide
GKVAGMPEAFEI

SEQ ID NO: 1557 - protein, 12 aa, Artificial Sequence
  Description of Artificial Sequence: Synthetic peptide
GKVAGMPEAFEI

SEQ ID NO: 1558 - protein, 12 aa, Artificial Sequence
  Description of Artificial Sequence: Synthetic peptide
GKVAGMPEAFEI

SEQ ID NO: 1559 - protein, 12 aa, Artificial Sequence
  Description of Artificial Sequence: Synthetic peptide
GKVAGMPEAFEI

SEQ ID NO: 1560 - protein, 12 aa, Artificial Sequence
  Description of Artificial Sequence: Synthetic peptide
GKVAGMPEAFEI

SEQ ID NO: 1561 - protein, 12 aa, Artificial Sequence
  Description of Artificial Sequence: Synthetic peptide
GKVAGMPEAFEI

SEQ ID NO: 1562 - protein, 20 aa, Artificial Sequence
  Description of Artificial Sequence: Synthetic peptide
GGDYVWGSYRPYYYYYGMDV

SEQ ID NO: 1563 - protein, 20 aa, Artificial Sequence
  Description of Artificial Sequence: Synthetic peptide
GGDYVWGSYRPYYYYYGMDV

SEQ ID NO: 1564 - protein, 20 aa, Artificial Sequence
  Description of Artificial Sequence: Synthetic peptide
GGDYVWGSYRPYYYYYGMDV

SEQ ID NO: 1565 - protein, 20 aa, Artificial Sequence
  Description of Artificial Sequence: Synthetic peptide
GGDYVWGSYRPYYYYYGMDV

SEQ ID NO: 1566 - protein, 20 aa, Artificial Sequence
  Description of Artificial Sequence: Synthetic peptide
GGDYVWGSYRPYYYYYGMDV

SEQ ID NO: 1567 - protein, 20 aa, Artificial Sequence
  Description of Artificial Sequence: Synthetic peptide
GGDYVWGSYRPYYYYYGMDV

SEQ ID NO: 1568 - protein, 20 aa, Artificial Sequence
  Description of Artificial Sequence: Synthetic peptide
GGDYVFGSYRPYYYYYGMDV

SEQ ID NO: 1569 - protein, 20 aa, Artificial Sequence
  Description of Artificial Sequence: Synthetic peptide
GGDYVFGSYRPYYYYYGMDV

SEQ ID NO: 1570 - protein, 12 aa, Artificial Sequence
  Description of Artificial Sequence: Synthetic peptide
GKVAGMPEAFEI

SEQ ID NO: 1571 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggt

SEQ ID NO: 1572 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggacattagagattatttaggctggtatcagcagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1573 - DNA, 324 bp, Artificial Sequence; identical to SEQ ID NO: 1572
  Description of Artificial Sequence: Synthetic polynucleotide

SEQ ID NO: 1574 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtttcaccatcagcagcctgcagcctgaagatattgcaacatattactgtcaacagtatgatattctcctcactttcggcggagggaccaaggtggagatcaagcga

SEQ ID NO: 1575 - DNA, 342 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacatagcttggtaccagcagcaaccaggacatcctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacga

SEQ ID NO: 1576 - DNA, 342 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacatagcttggtaccagcagaaaccaggacatcctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacga

SEQ ID NO: 1577 - DNA, 342 bp, Artificial Sequence
  Description of Artificial Sequence: Synthetic polynucleotide
gacatcgtgatgacccagtctccagactccctgtctgtgtctctgggcgagagggccaccatcaactgcaagtccagccagagtgttttatccagctccaacaataagaactacttagcttggtaccaacagaaaccaggacagcctcctaacctgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1578 - DNA, 342 bp, Artificial Sequence
  Description of Artificial Sequence: Synthetic polynucleotide
gacatcgtgatgacccagtctccagactccctgtctgtgtctctgggcgagagggccaccatcaactgcaagtccagccagagtgttttatccagctccaacaataagaactacttagcttggtaccagcagaaaccaggacagcctcctaacctgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1579 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattagttacagttacttagcctggtaccagcagaaacctggccaggctccccggctcctcatctatggtgcatccagcagggccactggcatcccagacaggttcagtggcagtgggtctgggacagacttcactctcaccatcagcagacaggagcctgatgattttgcagtgtattactgtcagcagtatggtagttcaccgctcactttcggcggagggaccaaggtggagatcaaacga

SEQ ID NO: 1580 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccagggtcagtggcagtgggtctgggacagagttcactctcaccatcagcagcctgcagtctgaagattttgcagtttattactgtcagcagtataataactggcctctcactttcggcggagggaccaaggtggagatcaaacga

SEQ ID NO: 1581 - DNA, 324 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgagttaggctggtatcagcagaaaccagggaaagcccctaaacgcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccctgggaccaaagtggatgtcaaacga

SEQ ID NO: 1582 - DNA, 321 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactttcaccatcagcagcctgcagcctgaagatattgcaacatattactgtcaacagtatgatgatctattcactttcggccctgggaccaaagtggatatcaaacga

SEQ ID NO: 1583 - DNA, 324 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtcttatcatctggttagcctggtatcagcagaaaccggggaaagcccctaaactcctgatctatgctgcatccagtttgcaaagtggggtcccatcaaggttcagcggcagtggctctgggacagatttcactctcaccatcagcagcctacagcctgaagattttgcaacttactattgtcaacagactaacagtttccctccgacgttcggccaagggaccaaggtggaaatcaaacga

SEQ ID NO: 1584 - DNA, 324 bp, Artificial Sequence; identical to SEQ ID NO: 1583
  Description of Artificial Sequence: Synthetic polynucleotide

SEQ ID NO: 1585 - DNA, 324 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgagttaggctggtatcagcagaaaccagggaaagcccctaaactcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccaagggaccaaagtggatgtcaaacga

SEQ ID NO: 1586 - DNA, 324 bp, Artificial Sequence; identical to SEQ ID NO: 1585
  Description of Artificial Sequence: Synthetic polynucleotide

SEQ ID NO: 1587 - DNA, 324 bp, Artificial Sequence; identical to SEQ ID NO: 1585
  Description of Artificial Sequence: Synthetic polynucleotide

SEQ ID NO: 1588 - DNA, 324 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgagttaggctggtatcagcagaaaccagggaaagcccctaaactcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccctgggaccaaagtggatgtcaaacga

SEQ ID NO: 1589 - DNA, 324 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgagttaggctggtatcagcagaaaccagggaaagcccctaaacgcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccaagggaccaaagtggatgtcaaacga

SEQ ID NO: 1590 - DNA, 324 bp, Artificial Sequence; identical to SEQ ID NO: 1585
  Description of Artificial Sequence: Synthetic polynucleotide

SEQ ID NO: 1591 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggacattagagattatttaggctggtatcagcagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacga

SEQ ID NO: 1592 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggacattagagattatttaggctggtatcagcagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacga

SEQ ID NO: 1593 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggacattagagattatttaggctggtatcagcagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1594 - DNA, 324 bp, Artificial Sequence; identical to SEQ ID NO: 1591
  Description of Artificial Sequence: Synthetic polynucleotide

SEQ ID NO: 1595 - DNA, 324 bp, Artificial Sequence; identical to SEQ ID NO: 1591
  Description of Artificial Sequence: Synthetic polynucleotide

SEQ ID NO: 1596 - DNA, 324 bp, Artificial Sequence; identical to SEQ ID NO: 1591
  Description of Artificial Sequence: Synthetic polynucleotide

SEQ ID NO: 1597 - DNA, 324 bp, Artificial Sequence; identical to SEQ ID NO: 1591
  Description of Artificial Sequence: Synthetic polynucleotide

SEQ ID NO: 1598 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaccagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1599 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaacagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1600 - DNA, 324 bp, Artificial Sequence; identical to SEQ ID NO: 1599
  Description of Artificial Sequence: Synthetic polynucleotide

SEQ ID NO: 1601 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaccagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1602 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaacagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1603 - DNA, 324 bp, Artificial Sequence; identical to SEQ ID NO: 1602
  Description of Artificial Sequence: Synthetic polynucleotide

SEQ ID NO: 1604 - DNA, 324 bp, Artificial Sequence; identical to SEQ ID NO: 1601
  Description of Artificial Sequence: Synthetic polynucleotide

SEQ ID NO: 1605 - DNA, 324 bp, Artificial Sequence; identical to SEQ ID NO: 1598
  Description of Artificial Sequence: Synthetic polynucleotide

SEQ ID NO: 1606 - DNA, 324 bp, Artificial Sequence; identical to SEQ ID NO: 1599
  Description of Artificial Sequence: Synthetic polynucleotide

SEQ ID NO: 1607 - DNA, 324 bp, Artificial Sequence; identical to SEQ ID NO: 1599
  Description of Artificial Sequence: Synthetic polynucleotide

SEQ ID NO: 1608 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaacagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacga

SEQ ID NO: 1609 - DNA, 324 bp, Artificial Sequence; identical to SEQ ID NO: 1599
  Description of Artificial Sequence: Synthetic polynucleotide

SEQ ID NO: 1610 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtctcaccatcagcagcctgcagcctgaagattttgcaacatattactgtcaacagtatgatattctcctcactttcggcggagggaccaaggtggagatcaagcga

SEQ ID NO: 1611 - DNA, 321 bp, Artificial Sequence; identical to SEQ ID NO: 1610
  Description of Artificial Sequence: Synthetic polynucleotide

SEQ ID NO: 1612 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtctcaccatcagcagcctgcagcctgaagatattgcaacatattactgtcaacagtatgatattctcctcactttcggcggagggaccaaggtggagatcaagcga

SEQ ID NO: 1613 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtttcaccatcagcagcctgcagcctgaagattttgcaacatattactgtcaacagtatgatattctcctcactttcggcggagggaccaaggtggagatcaagcga

SEQ ID NO: 1614 - DNA, 321 bp, Artificial Sequence; identical to SEQ ID NO: 1612
  Description of Artificial Sequence: Synthetic polynucleotide

SEQ ID NO: 1615 - DNA, 321 bp, Artificial Sequence; identical to SEQ ID NO: 1613
  Description of Artificial Sequence: Synthetic polynucleotide

SEQ ID NO: 1616 - DNA, 321 bp, Artificial Sequence; identical to SEQ ID NO: 1574
  Description of Artificial Sequence: Synthetic polynucleotide

SEQ ID NO: 1617 - DNA, 321 bp, Artificial Sequence; identical to SEQ ID NO: 1610
  Description of Artificial Sequence: Synthetic polynucleotide

SEQ ID NO: 1618 - DNA, 321 bp, Artificial Sequence; identical to SEQ ID NO: 1610
  Description of Artificial Sequence: Synthetic polynucleotide

SEQ ID NO: 1619 - DNA, 324 bp, Artificial Sequence; identical to SEQ ID NO: 1572
  Description of Artificial Sequence: Synthetic polynucleotide

SEQ ID NO: 1620 - DNA, 324 bp, Artificial Sequence; identical to SEQ ID NO: 1572
  Description of Artificial Sequence: Synthetic polynucleotide

SEQ ID NO: 1621 - DNA, 324 bp, Artificial Sequence; identical to SEQ ID NO: 1591
  Description of Artificial Sequence: Synthetic polynucleotide

SEQ ID NO: 1622 - DNA, 324 bp, Artificial Sequence; identical to SEQ ID NO: 1591
  Description of Artificial Sequence: Synthetic polynucleotide

SEQ ID NO: 1623 - DNA, 324 bp, Artificial Sequence; identical to SEQ ID NO: 1593
  Description of Artificial Sequence: Synthetic polynucleotide

SEQ ID NO: 1624 - DNA, 324 bp, Artificial Sequence; identical to SEQ ID NO: 1593
  Description of Artificial Sequence: Synthetic polynucleotide

SEQ ID NO: 1625 - DNA, 324 bp, Artificial Sequence; identical to SEQ ID NO: 1593
  Description of Artificial Sequence: Synthetic polynucleotide

SEQ ID NO: 1626 - DNA, 321 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagattttgcaacatattactgtcaacagtatgatgatctattcactttcggccctgggaccaaagtggatatcaaacga

SEQ ID NO: 1627 - DNA, 321 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagatattgcaacatattactgtcaacagtatgatgatctattcactttcggccctgggaccaaagtggatatcaaacga

SEQ ID NO: 1628 - DNA, 321 bp, Artificial Sequence; identical to SEQ ID NO: 1626
  Description of Artificial Sequence: Synthetic polynucleotide

SEQ ID NO: 1629 - DNA, 321 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactttcaccatcagcagcctgcagcctgaagattttgcaacatattactgtcaacagtatgatgatctattcactttcggccctgggaccaaagtggatatcaaacga

SEQ ID NO: 1630 - DNA, 321 bp, Artificial Sequence; identical to SEQ ID NO: 1627
  Description of Artificial Sequence: Synthetic polynucleotide

SEQ ID NO: 1631 - DNA, 321 bp, Artificial Sequence; identical to SEQ ID NO: 1629
  Description of Artificial Sequence: Synthetic polynucleotide

SEQ ID NO: 1632 - DNA, 321 bp, Artificial Sequence; identical to SEQ ID NO: 1582
  Description of Artificial Sequence: Synthetic polynucleotide

SEQ ID NO: 1633 - DNA, 321 bp, Artificial Sequence; identical to SEQ ID NO: 1626
  Description of Artificial Sequence: Synthetic polynucleotide

SEQ ID NO: 1634 - DNA, 321 bp, Artificial Sequence; identical to SEQ ID NO: 1626
  Description of Artificial Sequence: Synthetic polynucleotide

SEQ ID NO: 1635 - DNA, 321 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagattttgcaacatattactgtcaacagtatgatgatctattcactttcggccaagggaccaaagtggatatcaaacga

SEQ ID NO: 1636 - DNA, 321 bp, Artificial Sequence; identical to SEQ ID NO: 1635
  Description of Artificial Sequence: Synthetic polynucleotide

SEQ ID NO: 1637 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagatttttaccagcacctacttagcctggtaccagcagaaacctggccaggctcccaggctcctcatctatggtgcatccagcagggccactggcatcccagacaggttcagtggcagtgggtctgggacagacttcactctcaccatcagcagattggagcctgaagattttgcagtgtattactgtcagcagtatggtagctcacctcgcttcggccaagggacacgactggagattaaacga

SEQ ID NO: 1638 - DNA, 324 bp, Artificial Sequence; identical to SEQ ID NO: 1637
  Description of Artificial Sequence: Synthetic polynucleotide

SEQ ID NO: 1639 - DNA, 324 bp, Artificial Sequence; identical to SEQ ID NO: 1637
  Description of Artificial Sequence: Synthetic polynucleotide

SEQ ID NO: 1640 - DNA, 324 bp, Artificial Sequence; identical to SEQ ID NO: 1637
  Description of Artificial Sequence: Synthetic polynucleotide

SEQ ID NO: 1641 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctgcagtctgaagattttgcagtttattactgtcagcagtataataactggcctctcactttcggcggagggaccaaggtggagatcaaacga

SEQ ID NO: 1642 - DNA, 324 bp, Artificial Sequence; identical to SEQ ID NO: 1641
  Description of Artificial Sequence: Synthetic polynucleotide

SEQ ID NO: 1643 - DNA, 324 bp, Artificial Sequence; identical to SEQ ID NO: 1641
  Description of Artificial Sequence: Synthetic polynucleotide

SEQ ID NO: 1644 - DNA, 324 bp, Artificial Sequence; identical to SEQ ID NO: 1580
  Description of Artificial Sequence: Synthetic polynucleotide

SEQ ID NO: 1645 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataacttccctctcactttcggcggagggaccaaggtggagatcaaacga

SEQ ID NO: 1646 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataactatcctctcactttcggcggagggaccaaggtggagatcaaacga

SEQ ID NO: 1647 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataactggcctctcactttcggcggagggaccaaggtggagatcaaacga

SEQ ID NO: 1648 - DNA, 324 bp, Artificial Sequence; identical to SEQ ID NO: 1647
  Description of Artificial Sequence: Synthetic polynucleotide

SEQ ID NO: 1649 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattagttacagttacttagcctggtaccagcagaaacctggccaggctccccggctcctcatctatggtgcatccagcagggccactggcatcccagacaggttcagtggcagtgggtctgggacagacttcactctcaccatcagcagactggagcctgatgattttgcagtgtattactgtcagcagtatggtagttcaccgctcactttcggcggagggaccaaggtggagatcaaacga

SEQ ID NO: 1650 - DNA, 327 bp, Artificial Sequence; identical to SEQ ID NO: 1579
  Description of Artificial Sequence: Synthetic polynucleotide

SEQ ID NO: 1651 - DNA, 327 bp, Artificial Sequence; identical to SEQ ID NO: 1649
  Description of Artificial Sequence: Synthetic polynucleotide

SEQ ID NO: 1652 - DNA, 327 bp, Artificial Sequence; identical to SEQ ID NO: 1649
  Description of Artificial Sequence: Synthetic polynucleotide

SEQ ID NO: 1653 - DNA, 327 bp, Artificial Sequence; identical to SEQ ID NO: 1649
  Description of Artificial Sequence: Synthetic polynucleotide

SEQ ID NO: 1654 - DNA, 327 bp, Artificial Sequence; identical to SEQ ID NO: 1579
  Description of Artificial Sequence: Synthetic polynucleotide

SEQ ID NO: 1655 - DNA, 327 bp, Artificial Sequence; identical to SEQ ID NO: 1579
  Description of Artificial Sequence: Synthetic polynucleotide

SEQ ID NO: 1656 - DNA, 342 bp, Artificial Sequence; identical to SEQ ID NO: 1575
  Description of Artificial Sequence: Synthetic polynucleotide

SEQ ID NO: 1657 - DNA, 342 bp, Artificial Sequence; identical to SEQ ID NO: 1575
  Description of Artificial Sequence: Synthetic polynucleotide

SEQ ID NO: 1658 - DNA, 342 bp, Artificial Sequence; identical to SEQ ID NO: 1575
  Description of Artificial Sequence: Synthetic polynucleotide

SEQ ID NO: 1659 - DNA, 342 bp, Artificial Sequence; identical to SEQ ID NO: 1575
  Description of Artificial Sequence: Synthetic polynucleotide

SEQ ID NO: 1660 - DNA, 342 bp, Artificial Sequence; identical to SEQ ID NO: 1575
  Description of Artificial Sequence: Synthetic polynucleotide

SEQ ID NO: 1661 - DNA, 342 bp, Artificial Sequence; identical to SEQ ID NO: 1575
  Description of Artificial Sequence: Synthetic polynucleotide

SEQ ID NO: 1662 - DNA, 342 bp, Artificial Sequence; identical to SEQ ID NO: 1575
  Description of Artificial Sequence: Synthetic polynucleotide

SEQ ID NO: 1663 - DNA, 342 bp, Artificial Sequence; identical to SEQ ID NO: 1575
  Description of Artificial Sequence: Synthetic polynucleotide

SEQ ID NO: 1664 - DNA, 342 bp, Artificial Sequence; identical to SEQ ID NO: 1575
  Description of Artificial Sequence: Synthetic polynucleotide

SEQ ID NO: 1665 - DNA, 342 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacatagcttggtaccagcagaaaccaggacaacctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacga

SEQ ID NO: 1666 - DNA, 342 bp, Artificial Sequence; identical to SEQ ID NO: 1665
  Description of Artificial Sequence: Synthetic polynucleotide

SEQ ID NO: 1667 - DNA, 342 bp, Artificial Sequence
  Description of Artificial Sequence: Synthetic polynucleotide
gacatcgtgatgacccagtctccagactccctgtctgtgtctctgggcgagagggccaccatcaactgcaagtccagccagagtgttttatccagctccaacaataagaactacttagcttggtaccaacagaaaccaggacagcctcctaacctgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1668 - DNA, 342 bp, Artificial Sequence; identical to SEQ ID NO: 1667
  Description of Artificial Sequence: Synthetic polynucleotide

SEQ ID NO: 1669 - DNA, 342 bp, Artificial Sequence; identical to SEQ ID NO: 1577
  Description of Artificial Sequence: Synthetic polynucleotide

SEQ ID NO: 1670 - DNA, 342 bp, Artificial Sequence; identical to SEQ ID NO: 1667
  Description of Artificial Sequence: Synthetic polynucleotide

SEQ ID NO: 1671 - DNA, 342 bp, Artificial Sequence; identical to SEQ ID NO: 1667
  Description of Artificial Sequence: Synthetic polynucleotide

SEQ ID NO: 1672 - DNA, 342 bp, Artificial Sequence; identical to SEQ ID NO: 1577
  Description of Artificial Sequence: Synthetic polynucleotide

SEQ ID NO: 1673 - DNA, 342 bp, Artificial Sequence; identical to SEQ ID NO: 1577
  Description of Artificial Sequence: Synthetic polynucleotide

SEQ ID NO: 1674 - DNA, 342 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacttagcttggtaccaacagaaaccaggacagcctcctaaactgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1675 - DNA, 342 bp, Artificial Sequence; identical to SEQ ID NO: 1667
  Description of Artificial Sequence: Synthetic polynucleotide

SEQ ID NO: 1676 - DNA, 342 bp, Artificial Sequence; identical to SEQ ID NO: 1576
  Description of Artificial Sequence: Synthetic polynucleotide

SEQ ID NO: 1677 - DNA, 342 bp, Artificial Sequence; identical to SEQ ID NO: 1576
  Description of Artificial Sequence: Synthetic polynucleotide

SEQ ID NO: 1678 - DNA, 342 bp, Artificial Sequence; identical to SEQ ID NO: 1576
  Description of Artificial Sequence: Synthetic polynucleotide

SEQ ID NO: 1679 - DNA, 342 bp, Artificial Sequence; identical to SEQ ID NO: 1665
  Description of Artificial Sequence: Synthetic polynucleotide

SEQ ID NO: 1680 - DNA, 342 bp, Artificial Sequence; identical to SEQ ID NO: 1665
  Description of Artificial Sequence: Synthetic polynucleotide

SEQ ID NO: 1681 - DNA, 342 bp, Artificial Sequence; identical to SEQ ID NO: 1578
  Description of Artificial Sequence: Synthetic polynucleotide

SEQ ID NO: 1682 - DNA, 342 bp, Artificial Sequence; identical to SEQ ID NO: 1578
  Description of Artificial Sequence: Synthetic polynucleotide

SEQ ID NO: 1683 - DNA, 342 bp, Artificial Sequence; identical to SEQ ID NO: 1578
  Description of Artificial Sequence: Synthetic polynucleotide

SEQ ID NO: 1684 - DNA, 342 bp, Artificial Sequence; identical to SEQ ID NO: 1578
  Description of Artificial Sequence: Synthetic polynucleotide

SEQ ID NO: 1685 - DNA, 342 bp, Artificial Sequence; identical to SEQ ID NO: 1578
  Description of Artificial Sequence: Synthetic polynucleotide

SEQ ID NO: 1686 - DNA, 342 bp, Artificial Sequence; identical to SEQ ID NO: 1578
  Description of Artificial Sequence: Synthetic polynucleotide

SEQ ID NO: 1687 - DNA, 342 bp, Artificial Sequence; identical to SEQ ID NO: 1578
  Description of Artificial Sequence: Synthetic polynucleotide

SEQ ID NO: 1688 - DNA, 342 bp, Artificial Sequence
  Description of Artificial Sequence: Synthetic polynucleotide
gacatcgtgatgacccagtctccagactccctgtctgtgtctctgggcgagagggccaccatcaactgcaagtccagccagagtgttttatccagctccaacaataagaactacttagcttggtaccagcagaaaccaggacagcctcctaacctgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1689 - DNA, 342 bp, Artificial Sequence; identical to SEQ ID NO: 1688
  Description of Artificial Sequence: Synthetic polynucleotide

SEQ ID NO: 1690 - DNA, 342 bp, Artificial Sequence; identical to SEQ ID NO: 1688
  Description of Artificial Sequence: Synthetic polynucleotide

SEQ ID NO: 1691 - DNA, 342 bp, Artificial Sequence; identical to SEQ ID NO: 1688
  Description of Artificial Sequence: Synthetic polynucleotide

SEQ ID NO: 1692 - DNA, 342 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacttagcttggtaccagcagaaaccaggacagcctcctaaactgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1693 - DNA, 342 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacttagcttggtaccagcagaaaccaggacagcctcctaaactgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1694 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgagtggtccggtattcggcggagggaccaagctgaccgtcctaggt

SEQ ID NO: 1695 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgcaaggtccggtattcggcggagggaccaagctgaccgtcctaggt

SEQ ID NO: 1696 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgagtggtccggtattcggcggagggaccaagctgaccgtcctaggt

SEQ ID NO: 1697 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgcaaggtccggtattcggcggagggaccaagctgaccgtcctaggt

SEQ ID NO: 1698 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggt

SEQ ID NO: 1699 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggt

SEQ ID NO: 1700 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgaatggtccggtattcggcggagggaccaagctgaccgtcctaggt

SEQ ID NO: 1701 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgcaaggtccggtattcggcggagggaccaagctgaccgtcctaggt

SEQ ID NO: 1702 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgagtggtccggtattcggcggagggaccaagctgaccgtcctaggt

SEQ ID NO: 1703 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatgctccggtattcggcggagggaccaagctgaccgtcctaggt

SEQ ID NO: 1704 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgaatggtccggtattcggcggagggaccaagctgaccgtcctaggt

SEQ ID NO: 1705 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgaatgctccggtattcggcggagggaccaagctgaccgtcctaggt

SEQ ID NO: 1706 - DNA, 333 bp, Artificial Sequence; identical to SEQ ID NO: 1705
  Description of Artificial Sequence: Synthetic polynucleotide

SEQ ID NO: 1707 - DNA, 333 bp, Artificial Sequence; identical to SEQ ID NO: 1694
  Description of Artificial Sequence: Synthetic polynucleotide

SEQ ID NO: 1708 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaacagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacga

SEQ ID NO: 1709 - DNA, 324 bp, Artificial Sequence; identical to SEQ ID NO: 1592
  Description of Artificial Sequence: Synthetic polynucleotide

SEQ ID NO: 1710 - DNA, 333 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcaactcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgagtggtccggtattcggcggagggaccaagctgaccgtcctaggt

SEQ ID NO: 1711 - DNA, 324 bp, Artificial Sequence
  Description of Artificial Sequence: Synthetic polynucleotide
gacatccagctgacccagtctccatcctccctgtctgcatctgtaggagacagagtcactatcacttgccgggcaagtcagaccattagcaggtttttaaattggtatcagcagaaacctgggaaagcccctgagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcacacga

SEQ ID NO: 1712 - DNA, 333 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggaaataattatgtatcctggtatgagcagttcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaaactgaccgtcctaggt

SEQ ID NO: 1713 - DNA, 324 bp, Artificial Sequence
  Description of Artificial Sequence: Synthetic polynucleotide
gacatccagctgacccagtctccatcctccctgtctgcatctgtaggagacagagtcactatcacttgccgggcaagtcagaccattagcaggtttttaaattggtatcagcagaaacctgggaaagcccctgagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcaaacga

SEQ ID NO: 1714 - DNA, 324 bp, Artificial Sequence; identical to SEQ ID NO: 1713
  Description of Artificial Sequence: Synthetic polynucleotide

SEQ ID NO: 1715 - DNA, 324 bp, Artificial Sequence; identical to SEQ ID NO: 1711
  Description of Artificial Sequence: Synthetic polynucleotide

SEQ ID NO: 1716 - DNA, 324 bp, Artificial Sequence
  Description of Artificial Sequence: Synthetic polynucleotide
gacatccagctgacccagtctccatcctccctgtctgcatctgtaggagacagagtcactatcacttgccgggcaagtcagaccattagcaggtttttaaattggtatcagcagaaacctgggaaagcccctaagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcaaacga

SEQ ID NO: 1717 - DNA, 324 bp, Artificial Sequence; identical to SEQ ID NO: 1713
  Description of Artificial Sequence: Synthetic polynucleotide

SEQ ID NO: 1718 - DNA, 324 bp, Artificial Sequence; identical to SEQ ID NO: 1713
  Description of Artificial Sequence: Synthetic polynucleotide

SEQ ID NO: 1719 - DNA, 333 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaaactgaccgtcctaggt

SEQ ID NO: 1720 - DNA, 333 bp, Artificial Sequence; identical to SEQ ID NO: 1719
  Description of Artificial Sequence: Synthetic polynucleotide

SEQ ID NO: 1721 - DNA, 333 bp, Artificial Sequence; identical to SEQ ID NO: 1712
  Description of Artificial Sequence: Synthetic polynucleotide

SEQ ID NO: 1722 - DNA, 333 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacattcgaaagcagcctgagtgctgtggtattcggcggagggaccaaactgaccgtcctaggt

SEQ ID NO: 1723 - DNA, 333 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagcagcctgagtgctgtggtattcggcggagggaccaaactgaccgtcctaggt

SEQ ID NO: 1724 - DNA, 333 bp, Artificial Sequence; identical to SEQ ID NO: 1723
  Description of Artificial Sequence: Synthetic polynucleotide

SEQ ID NO: 1725 - DNA, 333 bp, Artificial Sequence; identical to SEQ ID NO: 1719
  Description of Artificial Sequence: Synthetic polynucleotide

SEQ ID NO: 1726 - DNA, 333 bp, Artificial Sequence; identical to SEQ ID NO: 1722
  Description of Artificial Sequence: Synthetic polynucleotide

SEQ ID NO: 1727 - DNA, 324 bp, Artificial Sequence
  Description of Artificial Sequence: Synthetic polynucleotide
gacatccagctgacccagtctccatcctccctgtctgcatctgtaggagacagagtcactatcacttgccgggcaagtcagaccattagcaggtttttaaattggtatcagcagaaacctgggaaagcccctaagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgctcagttttggccaggggaccaagctggagatcaaacga

SEQ ID NO: 1728 - DNA, 384 bp, Artificial Sequence
  Description of Artificial Sequence: Synthetic polynucleotide
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcaggctgaggtctgacgacacggccgtgtattactgtgcgagagggggggattacgtttgggggacttatcggcctcactactactacggtatggacgtctggggccaagggaccacggtcaccgtctcctca

SEQ ID NO: 1729 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatggaagtaatgaaaactatgcagactccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctca

SEQ ID NO: 1730 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatggaagtaataaatactatgcagactccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctca

SEQ ID NO: 1731 - DNA, 360 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagcgacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1732 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1733 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgacagtggtggcacagactattcacagaggtttcagggcaggttcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctca

SEQ ID NO: 1734 - DNA, 369 bp, Artificial Sequence
  Description of Artificial Sequence: Synthetic polynucleotide
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgacacaagctatgcacagaagtttcaggacagggtcaccatgaccagggacacgtccatcagcacagcctatatggagctgagcagactgagatctgacgacacggccgtgtatttctgtacgagagaggccacgatttttggaatgcttattgtaccatttgactactggggccagggaaccctggtcaccgtctcctca

SEQ ID NO: 1735 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgacacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctca

SEQ ID NO: 1736 - DNA, 378 bp, Artificial Sequence
  Description of Artificial Sequence: Synthetic polynucleotide
caggtgcagttgcaggagtcgggcccaggactggtgaagccttcacagaccctgtccctcacctgcactgtctctggtgactccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctca

SEQ ID NO: 1737 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatggaagtgataaatactatgcagactccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1738 - DNA, 363 bp, Artificial Sequence; identical to SEQ ID NO: 1730
  Description of Artificial Sequence: Synthetic polynucleotide

SEQ ID NO: 1739 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatggaaataataaatactatgcagactccgtgaagggccgattcaccatctccagagacagttccaagaacacgctgtatctgcaaatgaacagcctgagagccgaggacacggctgtgtattactgtgcgagagatcggacgatttttggagtggtccttgagtacctcggccagggaaccctggtcaccgtctcctca

SEQ ID NO: 1740 - DNA, 351 bp, Artificial Sequence
  Description of Artificial Sequence: Synthetic polynucleotide
caggtgcagctgcaggagtcgggcccaggactggtgaagccttcggagaccctgtccctcacctgcactgtctctcagggctccatcagtagttactactggagctggatccggcagcccgccgggaagggactagagtggattggccgtatctataccagtgggagcaccaactacaacccctccctcaagagtcgagtcaccatgtcaatagacacgtccaagaaccagttctccctgaaactgaactctgtgaccgccgcggacacggccgtgtattactgtgcgagagatgtagcagtggctggctttgactactggggccagggaaccctggtcaccgtctcctca

SEQ ID NO: 1741 - DNA, 351 bp, Artificial Sequence
  Description of Artificial Sequence: Synthetic polynucleotide
caggtgcagctgcaggagtcgggcccaggactggtgaagccttcggagaccctgtccctcacctgcactgtctctgggggctccatcagtagttactactggagctggatccggcagcccgccgggaagggactagagtggattggccgtatctataccagtgggagcaccaactacaacccctccctcaagagtcgagtcaccatgtcaatagacacgtccaagaaccagttctccctgaaactgaactctgtgaccgccgcggacacggccgtgtattactgtgcgagagatgtagcagtggctggctttgactactggggccagggaaccctggtcaccgtctcctca

SEQ ID NO: 1742 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagacgccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctca

SEQ ID NO: 1743 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagactccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctca

SEQ ID NO: 1744 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatggaagtaataaatactatgcagacgccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctca

SEQ ID NO: 1745 - DNA, 363 bp, Artificial Sequence; identical to SEQ ID NO: 1742
  Description of Artificial Sequence: Synthetic polynucleotide

SEQ ID NO: 1746 - DNA, 363 bp, Artificial Sequence; identical to SEQ ID NO: 1742
  Description of Artificial Sequence: Synthetic polynucleotide

SEQ ID NO: 1747 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagacgccgtgaagggccgcttcaccatctccagagacaattccaagaacacgctgtatctgcaaatgaacagcctgagagccgaggacacggctgtgtattactgtgcgcgagataggacgatttttggagtgctcttgggggactactggggccagggaaccctggtcaccgtctcctca

SEQ ID NO: 1748 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgcggacacggctgtgtattattgtgcgcgagatgggacgatctttggagtggtcttgggggactactggggccagggaaccctggtcaccgtctcctca

SEQ ID NO: 1749 - DNA, 363 bp, Artificial Sequence; identical to SEQ ID NO: 1748
  Description of Artificial Sequence: Synthetic polynucleotide

SEQ ID NO: 1750 - DNA, 363 bp, Artificial Sequence; identical to SEQ ID NO: 1748
  Description of Artificial Sequence: Synthetic polynucleotide

SEQ ID NO: 1751 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagactccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctca

SEQ ID NO: 1752 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatggaagtaatgaaaactatgcagacgccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctca

SEQ ID NO: 1753 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgaggacacggctgtgtattattgtgcgcgagataggacgatctttggagtggtcttgggggactactggggccagggaaccctggtcaccgtctcctca

SEQ ID NO: 1754 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgaggacacggctgtgtattattgtgcgcgagatgggacgatctttggagtggtcttgggggactactggggccagggaaccctggtcaccgtctcctca

SEQ ID NO: 1755 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatggaagtaatgaaaactatgcagactccgtgaagggccgattcaccatctccagagacaattccaagaacacgctgtatctgcacatgaacagcctgagagccgcggacacggctgtgtattactgtgcgagagatgggacgatctttggagtggtcttgggggactactggggccagggaaccctggtcaccgtctcctca

SEQ ID NO: 1756 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctca

SEQ ID NO: 1757 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcacatgaacagcctgagagccgcggacacggctgtgtattactgtgcgagagatgggacgatctttggagtggtcttgggggactactggggccagggaaccctggtcaccgtctcctca

SEQ ID NO: 1758 - DNA, 363 bp, Artificial Sequence; identical to SEQ ID NO: 1756
  Description of Artificial Sequence: Synthetic polynucleotide

SEQ ID NO: 1759 - DNA, 363 bp, Artificial Sequence; identical to SEQ ID NO: 1756
  Description of Artificial Sequence: Synthetic polynucleotide

SEQ ID NO: 1760 - DNA, 363 bp, Artificial Sequence; identical to SEQ ID NO: 1757
  Description of Artificial Sequence: Synthetic polynucleotide

SEQ ID NO: 1761 - DNA, 363 bp, Artificial Sequence; identical to SEQ ID NO: 1757
  Description of Artificial Sequence: Synthetic polynucleotide

SEQ ID NO: 1762 - DNA, 363 bp, Artificial Sequence; identical to SEQ ID NO: 1756
  Description of Artificial Sequence: Synthetic polynucleotide

SEQ ID NO: 1763 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatggaagtaatgaaaactatgcagacgccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctca

SEQ ID NO: 1764 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagactccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctca

SEQ ID NO: 1765 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgaggacacggctgtgtattactgtgcgagagataggacgatctttggagtggtcttgggggactactggggccagggaaccctggtcaccgtctcctca

SEQ ID NO: 1766 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgaggacacggctgtgtattactgtgcgagagatgggacgatctttggagtggtcttgggggactactggggccagggaaccctggtcaccgtctcctca

SEQ ID NO: 1767 - DNA, 360 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagacgccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1768 - DNA, 360 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagacgccgtgaagggccgattcaccatctccagcgacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1769 - DNA, 360 bp, Artificial Sequence; identical to SEQ ID NO: 1767
  Description of Artificial Sequence: Synthetic polynucleotide

SEQ ID NO: 1770 - DNA, 360 bp, Artificial Sequence; identical to SEQ ID NO: 1767
  Description of Artificial Sequence: Synthetic polynucleotide

SEQ ID NO: 1771 - DNA, 360 bp, Artificial Sequence; identical to SEQ ID NO: 1768
  Description of Artificial Sequence: Synthetic polynucleotide

SEQ ID NO: 1772 - DNA, 360 bp, Artificial Sequence; identical to SEQ ID NO: 1768
  Description of Artificial Sequence: Synthetic polynucleotide

SEQ ID NO: 1773 - DNA, 360 bp, Artificial Sequence; identical to SEQ ID NO: 1767
  Description of Artificial Sequence: Synthetic polynucleotide

SEQ ID NO: 1774 - DNA, 360 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagactccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1775 - DNA, 360 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagacgccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1776 - DNA, 363 bp, Artificial Sequence; identical to SEQ ID NO: 1742
  Description of Artificial Sequence: Synthetic polynucleotide

SEQ ID NO: 1777 - DNA, 363 bp, Artificial Sequence; identical to SEQ ID NO: 1747
  Description of Artificial Sequence: Synthetic polynucleotide

SEQ ID NO: 1778 - DNA, 363 bp, Artificial Sequence; identical to SEQ ID NO: 1742
  Description of Artificial Sequence: Synthetic polynucleotide

SEQ ID NO: 1779 - DNA, 363 bp, Artificial Sequence; identical to SEQ ID NO: 1747
  Description of Artificial Sequence: Synthetic polynucleotide

SEQ ID NO: 1780 - DNA, 363 bp, Artificial Sequence; identical to SEQ ID NO: 1730
  Description of Artificial Sequence: Synthetic polynucleotide

SEQ ID NO: 1781 - DNA, 363 bp, Artificial Sequence; identical to SEQ ID NO: 1743
  Description of Artificial Sequence: Synthetic polynucleotide

SEQ ID NO: 1782 - DNA, 363 bp, Artificial Sequence; identical to SEQ ID NO: 1744
  Description of Artificial Sequence: Synthetic polynucleotide

SEQ ID NO: 1783 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctca

SEQ ID NO: 1784 - DNA, 360 bp, Artificial Sequence; identical to SEQ ID NO: 1783
  Description of Artificial Sequence: Synthetic polynucleotide

SEQ ID NO: 1785 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtacctcggccagggaaccctggtcaccgtctcctca

SEQ ID NO: 1786 - DNA, 360 bp, Artificial Sequence; identical to SEQ ID NO: 1783
  Description of Artificial Sequence: Synthetic polynucleotide

SEQ ID NO: 1787 - DNA, 360 bp, Artificial Sequence; identical to SEQ ID NO: 1785
  Description of Artificial Sequence: Synthetic polynucleotide

SEQ ID NO: 1788 - DNA, 360 bp, Artificial Sequence; identical to SEQ ID NO: 1785
  Description of Artificial Sequence: Synthetic polynucleotide

SEQ ID NO: 1789 - DNA, 360 bp, Artificial Sequence; identical to SEQ ID NO: 1783
  Description of Artificial Sequence: Synthetic polynucleotide

SEQ ID NO: 1790 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatggaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctca

SEQ ID NO: 1791 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagactccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctca

SEQ ID NO: 1792 - DNA, 360 bp, Artificial Sequence; identical to SEQ ID NO: 1783
  Description of Artificial Sequence: Synthetic polynucleotide

SEQ ID NO: 1793 - DNA, 360 bp, Artificial Sequence; identical to SEQ ID NO: 1785
  Description of Artificial Sequence: Synthetic polynucleotide

SEQ ID NO: 1794 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatgcaagtaataaatactatgaagacgccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctca

SEQ ID NO: 1795 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatggaagtaataaatactatgaagactccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctca

SEQ ID NO: 1796 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatggaagtaataaatactatgaagacgccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctca

SEQ ID NO: 1797 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatgcaagtaataaatactatgaagactccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctca

SEQ ID NO: 1798 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1799 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagactccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1800 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatggaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1801 - DNA, 360 bp, Artificial Sequence; identical to SEQ ID NO: 1798
  Description of Artificial Sequence: Synthetic polynucleotide

SEQ ID NO: 1802 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcaaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1803 - DNA, 360 bp, Artificial Sequence; identical to SEQ ID NO: 1802
  Description of Artificial Sequence: Synthetic polynucleotide

SEQ ID NO: 1804 - DNA, 360 bp, Artificial Sequence; identical to SEQ ID NO: 1798
  Description of Artificial Sequence: Synthetic polynucleotide

SEQ ID NO: 1805 - DNA, 360 bp, Artificial Sequence; identical to SEQ ID NO: 1802
  Description of Artificial Sequence: Synthetic polynucleotide

SEQ ID NO: 1806 - DNA, 378 bp, Artificial Sequence
  Description of Artificial Sequence: Synthetic polynucleotide
caggtgcagttgcaggagtcgggcccaggactggtgaagccttcagagaccctgtccctcacctgcactgtctctggtgactccatcagcagtggtggttactactggagctggatccgccagcccccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctca

SEQ ID NO: 1807 - DNA, 378 bp, Artificial Sequence; identical to SEQ ID NO: 1806
  Description of Artificial Sequence: Synthetic polynucleotide

SEQ ID NO: 1808 - DNA, 378 bp, Artificial Sequence
  Description of Artificial Sequence: Synthetic polynucleotide
caggtgcagttgcaggagtcgggcccaggactggtgaagccttcacagaccctgtccctcacctgcactgtctctggtgactccatcagcagtggtggttactactggagctggatccgccagcccccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctca

SEQ ID NO: 1809 - DNA, 378 bp, Artificial Sequence
  Description of Artificial Sequence: Synthetic polynucleotide
caggtgcagttgcaggagtcgggcccaggactggtgaagccttcagagaccctgtccctcacctgcactgtctctggtgactccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctca

SEQ ID NO: 1810 - DNA, 378 bp, Artificial Sequence; identical to SEQ ID NO: 1736
  Description of Artificial Sequence: Synthetic polynucleotide

SEQ ID NO: 1811 - DNA, 378 bp, Artificial Sequence; identical to SEQ ID NO: 1809
  Description of Artificial Sequence: Synthetic polynucleotide

SEQ ID NO: 1812 - DNA, 378 bp, Artificial Sequence; identical to SEQ ID NO: 1808
  Description of Artificial Sequence: Synthetic polynucleotide

SEQ ID NO: 1813 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1814 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1815 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1816 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1817 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1818 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1819 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1820 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1821 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1822 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacagcctgagatctgacgacacggccgtgtattactgtgcgagagaggccacgatttttggaatggttattgtaccgtttgactactggggccagggaaccctggtcaccgtctcctca

SEQ ID NO: 1823 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcagggtcaccatgaccagggacacgtccatcagcacagcctacatggaactgaacagcctgagatctgacgacacggccgtgtattactgtgcgagagaggccacgatttttggaatggttattgtaccgtttgactactggggccagggaaccctggtcaccgtctcctca

SEQ ID NO: 1824 - DNA, 369 bp, Artificial Sequence
  Description of Artificial Sequence: Synthetic polynucleotide
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctca

SEQ ID NO: 1825 - DNA, 369 bp, Artificial Sequence
  Description of Artificial Sequence: Synthetic polynucleotide
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgacacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctca

SEQ ID NO: 1826 - DNA, 369 bp, Artificial Sequence; identical to SEQ ID NO: 1824
  Description of Artificial Sequence: Synthetic polynucleotide

SEQ ID NO: 1827 - DNA, 369 bp, Artificial Sequence
  Description of Artificial Sequence: Synthetic polynucleotide
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtacgagagaggccacgatttttggaatgcttattgtaccatttgactactggggccagggaaccctggtcaccgtctcctca

SEQ ID NO: 1828 - DNA, 369 bp, Artificial Sequence; identical to SEQ ID NO: 1734
  Description of Artificial Sequence: Synthetic polynucleotide

SEQ ID NO: 1829 - DNA, 369 bp, Artificial Sequence; identical to SEQ ID NO: 1827
  Description of Artificial Sequence: Synthetic polynucleotide

SEQ ID NO: 1830 - DNA, 369 bp, Artificial Sequence; identical to SEQ ID NO: 1825
  Description of Artificial Sequence: Synthetic polynucleotide

SEQ ID NO: 1831 - DNA, 369 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacaccttcaccggctactatatacactgggtgcgtcaggcccctggacaagggcttgagtggatggggtggatcagccctaacagtggtgaaacaagctatgcacagaagtttcaggacagggtcaccatgaccagggacacgtccatcagcacagcctatatggagctgagcagcctgagatctgacgacacggccgtgtatttctgtgcgagagaggccacgatttttggaatgcttattgtaccatttgactactggggccagggaaccctggtcaccgtctcctca

SEQ ID NO: 1832 - DNA, 369 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacaccttcaccggctactatatacactgggtgcgtcaggcccctggacaagggcttgagtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctca

SEQ ID NO: 1833 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcagggtcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctca

SEQ ID NO: 1834 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcaggttcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctca

SEQ ID NO: 1835 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgacagtggtggcacagactattcacagaggtttcagggcagggtcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctca

SEQ ID NO: 1836 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcagggtcaccatgaccagggacacgtccatcagcacagcctacatggaactgagcagcctgagatctgacgacacggccgtgtattactgtgcgagagaggccacgatttttggaatggttattgtaccgtttgactactggggccagggaaccctggtcaccgtctcctca

SEQ ID NO: 1837 - DNA, 369 bp, Artificial Sequence; identical to SEQ ID NO: 1833
  Description of Artificial Sequence: Synthetic polynucleotide

SEQ ID NO: 1838 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctca

SEQ ID NO: 1839 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgacacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctca

SEQ ID NO: 1840 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctca

SEQ ID NO: 1841 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgaaacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctca

SEQ ID NO: 1842 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgacacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctca

SEQ ID NO: 1843 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgacacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctca

SEQ ID NO: 1844 - DNA, 369 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgaaacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctca

SEQ ID NO: 1845 - DNA, 369 bp, Artificial Sequence; identical to SEQ ID NO: 1838
  Description of Artificial Sequence: Synthetic polynucleotide

SEQ ID NO: 1846 - DNA, 369 bp, Artificial Sequence; identical to SEQ ID NO: 1842
  Description of Artificial Sequence: Synthetic polynucleotide

SEQ ID NO: 1847 - DNA, 369 bp, Artificial Sequence; identical to SEQ ID NO: 1839
  Description of Artificial Sequence: Synthetic polynucleotide

SEQ ID NO: 1848 - DNA, 369 bp, Artificial Sequence; identical to SEQ ID NO: 1841
  Description of Artificial Sequence: Synthetic polynucleotide

SEQ ID NO: 1849 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcagcctgagatctgacgacacggccgtgtattactgtgcgagagaggccacgatttttggaatgcttattgtaccatttgactactggggccagggaaccctggtcaccgtctcctca

SEQ ID NO: 1850 - DNA, 369 bp, Artificial Sequence; identical to SEQ ID NO: 1849
  Description of Artificial Sequence: Synthetic polynucleotide

SEQ ID NO: 1851 - DNA, 384 bp, Artificial Sequence; identical to SEQ ID NO: 1728
  Description of Artificial Sequence: Synthetic polynucleotide

SEQ ID NO: 1852 - DNA, 384 bp, Artificial Sequence; identical to SEQ ID NO: 1728
  Description of Artificial Sequence: Synthetic polynucleotide

SEQ ID NO: 1853 - DNA, 384 bp, Artificial Sequence; identical to SEQ ID NO: 1728
  Description of Artificial Sequence: Synthetic polynucleotide

SEQ ID NO: 1854 - DNA, 384 bp, Artificial Sequence; identical to SEQ ID NO: 1728
  Description of Artificial Sequence: Synthetic polynucleotide

SEQ ID NO: 1855 - DNA, 384 bp, Artificial Sequence; identical to SEQ ID NO: 1728
  Description of Artificial Sequence: Synthetic polynucleotide

SEQ ID NO: 1856 - DNA, 384 bp, Artificial Sequence; identical to SEQ ID NO: 1728
  Description of Artificial Sequence: Synthetic polynucleotide

SEQ ID NO: 1857 - DNA, 384 bp, Artificial Sequence; identical to SEQ ID NO: 1728
  Description of Artificial Sequence: Synthetic polynucleotide

SEQ ID NO: 1858 - DNA, 384 bp, Artificial Sequence; identical to SEQ ID NO: 1728
  Description of Artificial Sequence: Synthetic polynucleotide

SEQ ID NO: 1859 - DNA, 384 bp, Artificial Sequence; identical to SEQ ID NO: 1728
  Description of Artificial Sequence: Synthetic polynucleotide

SEQ ID NO: 1860 - DNA, 384 bp, Artificial Sequence; identical to SEQ ID NO: 1728
  Description of Artificial Sequence: Synthetic polynucleotide

SEQ ID NO: 1861 - DNA, 384 bp, Artificial Sequence; identical to SEQ ID NO: 1728
  Description of Artificial Sequence: Synthetic polynucleotide

SEQ ID NO: 1862 - DNA, 384 bp, Artificial Sequence; identical to SEQ ID NO: 1728
  Description of Artificial Sequence: Synthetic polynucleotide

SEQ ID NO: 1863 - DNA, 384 bp, Artificial Sequence
  Description of Artificial Sequence: Synthetic polynucleotide
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcagcctgaggtctgacgacacggccgtgtattactgtgcgagagggggggattacgttttcgggacttatcggcctcactactactacggtatggacgtctggggccaagggaccacggtcaccgtctcctca

SEQ ID NO: 1864 - DNA, 384 bp, Artificial Sequence
  Description of Artificial Sequence: Synthetic polynucleotide
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcaggctgaggtctgacgacacggccgtgtattactgtgcgagagggggggattacgttttcgggacttatcggcctcactactactacggtatggacgtctggggccaagggaccacggtcaccgtctcctca

SEQ ID NO: 1865 - DNA, 363 bp, Artificial Sequence; identical to SEQ ID NO: 1765
  Description of Artificial Sequence: Synthetic polynucleotide

SEQ ID NO: 1866 - DNA, 363 bp, Artificial Sequence; identical to SEQ ID NO: 1747
  Description of Artificial Sequence: Synthetic polynucleotide

SEQ ID NO: 1867 - DNA, 384 bp, Artificial Sequence; identical to SEQ ID NO: 1728
  Description of Artificial Sequence: Synthetic polynucleotide

SEQ ID NO: 1868 - DNA, 363 bp, Artificial Sequence
  Description of Artificial Sequence: Synthetic polynucleotide
caggtgcagttggtggagtctgggggaggcgtggtccagcctgggaggtccctgagactctcctgtacagcgtctggattcaccttcagtagctatggcatacactgggtccgccaggctccaggcaaggggctggagtgggtggcagttatatggtatgatggaagtaataagttccatgcagactccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1869 - DNA, 387 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccagggacacctccataagcacagcctacatggagctgagcagcctgagatctcaggacacggccgtgtattactgtgcgagagggggtgattacgtttgggggagttatcgtccctactactactactacggtatggacgtctggggccaagggaccacggtcaccgtctcctca

SEQ ID NO: 1870 - DNA, 363 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1871 - DNA, 363 bp, Artificial Sequence
  Description of Artificial Sequence: Synthetic polynucleotide
caggtgcagttggtggagtctgggggaggcgtggtccagcctgggaggtccctgagactctcctgtacagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1872 - DNA, 363 bp, Artificial Sequence; identical to SEQ ID NO: 1870
  Description of Artificial Sequence: Synthetic polynucleotide

SEQ ID NO: 1873 - DNA, 363 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacattggtcaccgtctcttca

SEQ ID NO: 1874 - DNA, 363 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagactccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1875 - DNA, 363 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatggaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1876 - DNA, 387 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtggcacaggctatgcacagaagttccagggcagagtcaccatgaccagggacacctccataagcacagcctacatggagctgagcagcctgagatctcaggacacggccgtgtattactgtgcgagagggggtgattacgtttgggggagttatcgtccctactactactactacggtatggacgtctggggccaagggaccacggtcaccgtctcctca

SEQ ID NO: 1877 - DNA, 387 bp, Artificial Sequence; identical to SEQ ID NO: 1869
  Description of Artificial Sequence: Synthetic polynucleotide

SEQ ID NO: 1878 - DNA, 387 bp, Artificial Sequence; identical to SEQ ID NO: 1876
  Description of Artificial Sequence: Synthetic polynucleotide

SEQ ID NO: 1879 - DNA, 387 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtggcacaggctatgcacagaagttccagggcagagtcaccatgaccagggacacctccataagcacagcctacatggagctgagcagcctgagatctgacgacacggccgtgtattactgtgcgagagggggtgattacgtttgggggagttatcgtccctactactactactacggtatggacgtctggggccaagggaccacggtcaccgtctcctca

SEQ ID NO: 1880 - DNA, 387 bp, Artificial Sequence; identical to SEQ ID NO: 1876
  Description of Artificial Sequence: Synthetic polynucleotide

SEQ ID NO: 1881 - DNA, 387 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtaacacaggctatgcacagaagttccagggcagagtcaccatgaccagggacacctccataagcacagcctacatggagctgagcagcctgagatctgacgacacggccgtgtattactgtgcgagagggggtgattacgtttgggggagttatcgtccctactactactactacggtatggacgtctggggccaagggaccacggtcaccgtctcctca

SEQ ID NO: 1882 - DNA, 387 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtggcacaggctatgcacagaagttccagggcagagtcaccatgaccagggacacctccataagcacagcctacatggagctgagcagcctgagatctcaggacacggccgtgtattactgtgcgagagggggtgattacgttttcgggagttatcgtccctactactactactacggtatggacgtctggggccaagggaccacggtcaccgtctcctca

SEQ ID NO: 1883 - DNA, 387 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtggcacaggctatgcacagaagttccagggcagagtcaccatgaccagggacacctccataagcacagcctacatggagctgagcagcctgagatctgacgacacggccgtgtattactgtgcgagagggggtgattacgttttcgggagttatcgtccctactactactactacggtatggacgtctggggccaagggaccacggtcaccgtctcctca

SEQ ID NO: 1884 - DNA, 363 bp, Artificial Sequence; identical to SEQ ID NO: 1873
  Description of Artificial Sequence: Synthetic polynucleotide

SEQ ID NO: 1885 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 1886 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggacattagagattatttaggctggtatcagcagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1887 - DNA, 642 bp, Artificial Sequence; identical to SEQ ID NO: 1886
  Description of Artificial Sequence: Synthetic polynucleotide

SEQ ID NO: 1888 - DNA, 639 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtttcaccatcagcagcctgcagcctgaagatattgcaacatattactgtcaacagtatgatattctcctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1889 - DNA, 660 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacatagcttggtaccagcagcaaccaggacatcctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1890 - DNA, 660 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacatagcttggtaccagcagaaaccaggacatcctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1891 - DNA, 660 bp, Artificial Sequence
  Description of Artificial Sequence: Synthetic polynucleotide
gacatcgtgatgacccagtctccagactccctgtctgtgtctctgggcgagagggccaccatcaactgcaagtccagccagagtgttttatccagctccaacaataagaactacttagcttggtaccaacagaaaccaggacagcctcctaacctgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1892 - DNA, 660 bp, Artificial Sequence
  Description of Artificial Sequence: Synthetic polynucleotide
gacatcgtgatgacccagtctccagactccctgtctgtgtctctgggcgagagggccaccatcaactgcaagtccagccagagtgttttatccagctccaacaataagaactacttagcttggtaccagcagaaaccaggacagcctcctaacctgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1893 - DNA, 645 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattagttacagttacttagcctggtaccagcagaaacctggccaggctccccggctcctcatctatggtgcatccagcagggccactggcatcccagacaggttcagtggcagtgggtctgggacagacttcactctcaccatcagcagacaggagcctgatgattttgcagtgtattactgtcagcagtatggtagttcaccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1894 - DNA, 642 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccagggtcagtggcagtgggtctgggacagagttcactctcaccatcagcagcctgcagtctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1895 - DNA, 642 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgagttaggctggtatcagcagaaaccagggaaagcccctaaacgcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccctgggaccaaagtggatgtcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1896 - DNA, 639 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactttcaccatcagcagcctgcagcctgaagatattgcaacatattactgtcaacagtatgatgatctattcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1897 - DNA, 642 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtcttatcatctggttagcctggtatcagcagaaaccggggaaagcccctaaactcctgatctatgctgcatccagtttgcaaagtggggtcccatcaaggttcagcggcagtggctctgggacagatttcactctcaccatcagcagcctacagcctgaagattttgcaacttactattgtcaacagactaacagtttccctccgacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1898 - DNA, 642 bp, Artificial Sequence; identical to SEQ ID NO: 1897
  Description of Artificial Sequence: Synthetic polynucleotide

SEQ ID NO: 1899 - DNA, 642 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgagttaggctggtatcagcagaaaccagggaaagcccctaaactcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccaagggaccaaagtggatgtcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1900 - DNA, 642 bp, Artificial Sequence; identical to SEQ ID NO: 1899
  Description of Artificial Sequence: Synthetic polynucleotide

SEQ ID NO: 1901 - DNA, 642 bp, Artificial Sequence; identical to SEQ ID NO: 1899
  Description of Artificial Sequence: Synthetic polynucleotide

SEQ ID NO: 1902 - DNA, 642 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgagttaggctggtatcagcagaaaccagggaaagcccctaaactcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccctgggaccaaagtggatgtcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1903 - DNA, 642 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgagttaggctggtatcagcagaaaccagggaaagcccctaaacgcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccaagggaccaaagtggatgtcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1904 - DNA, 642 bp, Artificial Sequence; identical to SEQ ID NO: 1899
  Description of Artificial Sequence: Synthetic polynucleotide

SEQ ID NO: 1905 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggacattagagattatttaggctggtatcagcagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1906 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggacattagagattatttaggctggtatcagcagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1907 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggacattagagattatttaggctggtatcagcagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1908 - DNA, 642 bp, Artificial Sequence; identical to SEQ ID NO: 1905
  Description of Artificial Sequence: Synthetic polynucleotide

SEQ ID NO: 1909 - DNA, 642 bp, Artificial Sequence; identical to SEQ ID NO: 1905
  Description of Artificial Sequence: Synthetic polynucleotide

SEQ ID NO: 1910 - DNA, 642 bp, Artificial Sequence; identical to SEQ ID NO: 1905
  Description of Artificial Sequence: Synthetic polynucleotide

SEQ ID NO: 1911 - DNA, 642 bp, Artificial Sequence; identical to SEQ ID NO: 1905
  Description of Artificial Sequence: Synthetic polynucleotide

SEQ ID NO: 1912 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaccagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1913 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaacagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1914 - DNA, 642 bp, Artificial Sequence; identical to SEQ ID NO: 1913
  Description of Artificial Sequence: Synthetic polynucleotide

SEQ ID NO: 1915 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaccagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1916 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaacagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1917 - DNA, 642 bp, Artificial Sequence; identical to SEQ ID NO: 1916
  Description of Artificial Sequence: Synthetic polynucleotide

SEQ ID NO: 1918 - DNA, 642 bp, Artificial Sequence; identical to SEQ ID NO: 1915
  Description of Artificial Sequence: Synthetic polynucleotide

SEQ ID NO: 1919 - DNA, 642 bp, Artificial Sequence; identical to SEQ ID NO: 1912
  Description of Artificial Sequence: Synthetic polynucleotide

SEQ ID NO: 1920 - DNA, 642 bp, Artificial Sequence; identical to SEQ ID NO: 1913
  Description of Artificial Sequence: Synthetic polynucleotide

SEQ ID NO: 1921 - DNA, 642 bp, Artificial Sequence; identical to SEQ ID NO: 1913
  Description of Artificial Sequence: Synthetic polynucleotide

SEQ ID NO: 1922 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaacagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1923 - DNA, 642 bp, Artificial Sequence; identical to SEQ ID NO: 1913
  Description of Artificial Sequence: Synthetic polynucleotide

SEQ ID NO: 1924 - DNA, 639 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtctcaccatcagcagcctgcagcctgaagattttgcaacatattactgtcaacagtatgatattctcctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1925 - DNA, 639 bp, Artificial Sequence; identical to SEQ ID NO: 1924
  Description of Artificial Sequence: Synthetic polynucleotide

SEQ ID NO: 1926 - DNA, 639 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtctcaccatcagcagcctgcagcctgaagatattgcaacatattactgtcaacagtatgatattctcctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1927 - DNA, 639 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtttcaccatcagcagcctgcagcctgaagattttgcaacatattactgtcaacagtatgatattctcctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1928 - DNA, 639 bp, Artificial Sequence; identical to SEQ ID NO: 1926
  Description of Artificial Sequence: Synthetic polynucleotide

SEQ ID NO: 1929 - DNA, 639 bp, Artificial Sequence; identical to SEQ ID NO: 1927
  Description of Artificial Sequence: Synthetic polynucleotide

SEQ ID NO: 1930 - DNA, 639 bp, Artificial Sequence; identical to SEQ ID NO: 1888
  Description of Artificial Sequence: Synthetic polynucleotide

SEQ ID NO: 1931 - DNA, 639 bp, Artificial Sequence; identical to SEQ ID NO: 1924
  Description of Artificial Sequence: Synthetic polynucleotide

SEQ ID NO: 1932 - DNA, 639 bp, Artificial Sequence; identical to SEQ ID NO: 1924
  Description of Artificial Sequence: Synthetic polynucleotide

SEQ ID NO: 1933 - DNA, 642 bp, Artificial Sequence; identical to SEQ ID NO: 1886
  Description of Artificial Sequence: Synthetic polynucleotide

SEQ ID NO: 1934 - DNA, 642 bp, Artificial Sequence; identical to SEQ ID NO: 1886
  Description of Artificial Sequence: Synthetic polynucleotide

SEQ ID NO: 1935 - DNA, 642 bp, Artificial Sequence; identical to SEQ ID NO: 1905
  Description of Artificial Sequence: Synthetic polynucleotide

SEQ ID NO: 1936 - DNA, 642 bp, Artificial Sequence; identical to SEQ ID NO: 1905
  Description of Artificial Sequence: Synthetic polynucleotide

SEQ ID NO: 1937 - DNA, 642 bp, Artificial Sequence; identical to SEQ ID NO: 1907
  Description of Artificial Sequence: Synthetic polynucleotide

SEQ ID NO: 1938 - DNA, 642 bp, Artificial Sequence; identical to SEQ ID NO: 1907
  Description of Artificial Sequence: Synthetic polynucleotide

SEQ ID NO: 1939 - DNA, 642 bp, Artificial Sequence; identical to SEQ ID NO: 1907
  Description of Artificial Sequence: Synthetic polynucleotide

SEQ ID NO: 1940 - DNA, 639 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagattttgcaacatattactgtcaacagtatgatgatctattcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1941 - DNA, 639 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagatattgcaacatattactgtcaacagtatgatgatctattcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1942 - DNA, 639 bp, Artificial Sequence; identical to SEQ ID NO: 1940
  Description of Artificial Sequence: Synthetic polynucleotide

SEQ ID NO: 1943 - DNA, 639 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactttcaccatcagcagcctgcagcctgaagattttgcaacatattactgtcaacagtatgatgatctattcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1944 - DNA, 639 bp, Artificial Sequence; identical to SEQ ID NO: 1941
  Description of Artificial Sequence: Synthetic polynucleotide

SEQ ID NO: 1945 - DNA, 639 bp, Artificial Sequence; identical to SEQ ID NO: 1943
  Description of Artificial Sequence: Synthetic polynucleotide

SEQ ID NO: 1946 - DNA, 639 bp, Artificial Sequence; identical to SEQ ID NO: 1896
  Description of Artificial Sequence: Synthetic polynucleotide

SEQ ID NO: 1947 - DNA, 639 bp, Artificial Sequence; identical to SEQ ID NO: 1940
  Description of Artificial Sequence: Synthetic polynucleotide

SEQ ID NO: 1948 - DNA, 639 bp, Artificial Sequence; identical to SEQ ID NO: 1940
  Description of Artificial Sequence: Synthetic polynucleotide

SEQ ID NO: 1949 - DNA, 639 bp, Artificial Sequence
  Description of Artificial Sequence: Synthetic polynucleotide
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagattttgcaacatattactgtcaacagtatgatgatctattcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1950 - DNA, 639 bp, Artificial Sequence; identical to SEQ ID NO: 1949
  Description of Artificial Sequence: Synthetic polynucleotide

SEQ ID NO: 1951 - DNA, 642 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagatttttaccagcacctacttagcctggtaccagcagaaacctggccaggctcccaggctcctcatctatggtgcatccagcagggccactggcatcccagacaggttcagtggcagtgggtctgggacagacttcactctcaccatcagcagattggagcctgaagattttgcagtgtattactgtcagcagtatggtagctcacctcgcttcggccaagggacacgactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1952 - DNA, 642 bp, Artificial Sequence; identical to SEQ ID NO: 1951
  Description of Artificial Sequence: Synthetic polynucleotide

SEQ ID NO: 1953 - DNA, 642 bp, Artificial Sequence; identical to SEQ ID NO: 1951
  Description of Artificial Sequence: Synthetic polynucleotide

SEQ ID NO: 1954 - DNA, 642 bp, Artificial Sequence; identical to SEQ ID NO: 1951
  Description of Artificial Sequence: Synthetic polynucleotide

SEQ ID NO: 1955 - DNA, 642 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctgcagtctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1956 - DNA, 642 bp, Artificial Sequence; identical to SEQ ID NO: 1955
  Description of Artificial Sequence: Synthetic polynucleotide

SEQ ID NO: 1957 - DNA, 642 bp, Artificial Sequence; identical to SEQ ID NO: 1955
  Description of Artificial Sequence: Synthetic polynucleotide

SEQ ID NO: 1958 - DNA, 642 bp, Artificial Sequence; identical to SEQ ID NO: 1894
  Description of Artificial Sequence: Synthetic polynucleotide

SEQ ID NO: 1959 - DNA, 642 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataacttccctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1960 - DNA, 642 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataactatcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1961 - DNA, 642 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1962 - DNA, 642 bp, Artificial Sequence; identical to SEQ ID NO: 1961
  Description of Artificial Sequence: Synthetic polynucleotide

SEQ ID NO: 1963 - DNA, 645 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattagttacagttacttagcctggtaccagcagaaacctggccaggctccccggctcctcatctatggtgcatccagcagggccactggcatcccagacaggttcagtggcagtgggtctgggacagacttcactctcaccatcagcagactggagcctgatgattttgcagtgtattactgtcagcagtatggtagttcaccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1964 - DNA, 645 bp, Artificial Sequence; identical to SEQ ID NO: 1893
  Description of Artificial Sequence: Synthetic polynucleotide

SEQ ID NO: 1965 - DNA, 645 bp, Artificial Sequence; identical to SEQ ID NO: 1963
  Description of Artificial Sequence: Synthetic polynucleotide

SEQ ID NO: 1966 - DNA, 645 bp, Artificial Sequence; identical to SEQ ID NO: 1963
  Description of Artificial Sequence: Synthetic polynucleotide

SEQ ID NO: 1967 - DNA, 645 bp, Artificial Sequence; identical to SEQ ID NO: 1963
  Description of Artificial Sequence: Synthetic polynucleotide

SEQ ID NO: 1968 - DNA, 645 bp, Artificial Sequence; identical to SEQ ID NO: 1893
  Description of Artificial Sequence: Synthetic polynucleotide

SEQ ID NO: 1969 - DNA, 645 bp, Artificial Sequence; identical to SEQ ID NO: 1893
  Description of Artificial Sequence: Synthetic polynucleotide

SEQ ID NO: 1970 - DNA, 660 bp, Artificial Sequence; identical to SEQ ID NO: 1889
  Description of Artificial Sequence: Synthetic polynucleotide

SEQ ID NO: 1971 - DNA, 660 bp, Artificial Sequence; identical to SEQ ID NO: 1889
  Description of Artificial Sequence: Synthetic polynucleotide

SEQ ID NO: 1972 - DNA, 660 bp, Artificial Sequence; identical to SEQ ID NO: 1889
  Description of Artificial Sequence: Synthetic polynucleotide

SEQ ID NO: 1973 - DNA, 660 bp, Artificial Sequence; identical to SEQ ID NO: 1889
  Description of Artificial Sequence: Synthetic polynucleotide

SEQ ID NO: 1974 - DNA, 660 bp, Artificial Sequence; identical to SEQ ID NO: 1889
  Description of Artificial Sequence: Synthetic polynucleotide

SEQ ID NO: 1975 - DNA, 660 bp, Artificial Sequence; identical to SEQ ID NO: 1889
  Description of Artificial Sequence: Synthetic polynucleotide

SEQ ID NO: 1976 - DNA, 660 bp, Artificial Sequence; identical to SEQ ID NO: 1889
  Description of Artificial Sequence: Synthetic polynucleotide

SEQ ID NO: 1977 - DNA, 660 bp, Artificial Sequence; identical to SEQ ID NO: 1889
  Description of Artificial Sequence: Synthetic polynucleotide

SEQ ID NO: 1978 - DNA, 660 bp, Artificial Sequence; identical to SEQ ID NO: 1889
  Description of Artificial Sequence: Synthetic polynucleotide

SEQ ID NO: 1979 - DNA, 660 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacatagcttggtaccagcagaaaccaggacaacctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1980 - DNA, 660 bp, Artificial Sequence; identical to SEQ ID NO: 1979
  Description of Artificial Sequence: Synthetic polynucleotide

SEQ ID NO: 1981 - DNA, 660 bp, Artificial Sequence
  Description of Artificial Sequence: Synthetic polynucleotide
gacatcgtgatgacccagtctccagactccctgtctgtgtctctgggcgagagggccaccatcaactgcaagtccagccagagtgttttatccagctccaacaataagaactacttagcttggtaccaacagaaaccaggacagcctcctaacctgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1982 - DNA, 660 bp, Artificial Sequence; identical to SEQ ID NO: 1981
  Description of Artificial Sequence: Synthetic polynucleotide

SEQ ID NO: 1983 - DNA, 660 bp, Artificial Sequence; identical to SEQ ID NO: 1891
  Description of Artificial Sequence: Synthetic polynucleotide

SEQ ID NO: 1984 - DNA, 660 bp, Artificial Sequence; identical to SEQ ID NO: 1981
  Description of Artificial Sequence: Synthetic polynucleotide

SEQ ID NO: 1985 - DNA, 660 bp, Artificial Sequence; identical to SEQ ID NO: 1981
  Description of Artificial Sequence: Synthetic polynucleotide

SEQ ID NO: 1986 - DNA, 660 bp, Artificial Sequence; identical to SEQ ID NO: 1891
  Description of Artificial Sequence: Synthetic polynucleotide

SEQ ID NO: 1987 - DNA, 660 bp, Artificial Sequence; identical to SEQ ID NO: 1891
  Description of Artificial Sequence: Synthetic polynucleotide

SEQ ID NO: 1988 - DNA, 660 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacttagcttggtaccaacagaaaccaggacagcctcctaaactgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1989 - DNA, 660 bp, Artificial Sequence; identical to SEQ ID NO: 1981
  Description of Artificial Sequence: Synthetic polynucleotide

SEQ ID NO: 1990 - DNA, 660 bp, Artificial Sequence; identical to SEQ ID NO: 1890
  Description of Artificial Sequence: Synthetic polynucleotide

SEQ ID NO: 1991 - DNA, 660 bp, Artificial Sequence; identical to SEQ ID NO: 1890
  Description of Artificial Sequence: Synthetic polynucleotide

SEQ ID NO: 1992 - DNA, 660 bp, Artificial Sequence; identical to SEQ ID NO: 1890
  Description of Artificial Sequence: Synthetic polynucleotide

SEQ ID NO: 1993 - DNA, 660 bp, Artificial Sequence; identical to SEQ ID NO: 1979
  Description of Artificial Sequence: Synthetic polynucleotide

SEQ ID NO: 1994 - DNA, 660 bp, Artificial Sequence; identical to SEQ ID NO: 1979
  Description of Artificial Sequence: Synthetic polynucleotide

SEQ ID NO: 1995 - DNA, 660 bp, Artificial Sequence; identical to SEQ ID NO: 1892
  Description of Artificial Sequence: Synthetic polynucleotide

SEQ ID NO: 1996 - DNA, 660 bp, Artificial Sequence; identical to SEQ ID NO: 1892
  Description of Artificial Sequence: Synthetic polynucleotide

SEQ ID NO: 1997 - DNA, 660 bp, Artificial Sequence; identical to SEQ ID NO: 1892
  Description of Artificial Sequence: Synthetic polynucleotide

SEQ ID NO: 1998 - DNA, 660 bp, Artificial Sequence; identical to SEQ ID NO: 1892
  Description of Artificial Sequence: Synthetic polynucleotide

SEQ ID NO: 1999 - DNA, 660 bp, Artificial Sequence; identical to SEQ ID NO: 1892
  Description of Artificial Sequence: Synthetic polynucleotide

SEQ ID NO: 2000 - DNA, 660 bp, Artificial Sequence; identical to SEQ ID NO: 1892
  Description of Artificial Sequence: Synthetic polynucleotide

SEQ ID NO: 2001 - DNA, 660 bp, Artificial Sequence; identical to SEQ ID NO: 1892
  Description of Artificial Sequence: Synthetic polynucleotide

SEQ ID NO: 2002 - DNA, 660 bp, Artificial Sequence
  Description of Artificial Sequence: Synthetic polynucleotide
gacatcgtgatgacccagtctccagactccctgtctgtgtctctgggcgagagggccaccatcaactgcaagtccagccagagtgttttatccagctccaacaataagaactacttagcttggtaccagcagaaaccaggacagcctcctaacctgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2003 - DNA, 660 bp, Artificial Sequence; identical to SEQ ID NO: 2002
  Description of Artificial Sequence: Synthetic polynucleotide

SEQ ID NO: 2004 - DNA, 660 bp, Artificial Sequence; identical to SEQ ID NO: 2002
  Description of Artificial Sequence: Synthetic polynucleotide

SEQ ID NO: 2005 - DNA, 660 bp, Artificial Sequence; identical to SEQ ID NO: 2002
  Description of Artificial Sequence: Synthetic polynucleotide

SEQ ID NO: 2006 - DNA, 660 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacttagcttggtaccagcagaaaccaggacagcctcctaaactgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2007 - DNA, 660 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaataagaactacttagcttggtaccagcagaaaccaggacagcctcctaaactgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2008 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgagtggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2009 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgcaaggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2010 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgagtggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2011 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgcaaggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2012 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2013 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2014 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2015 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgcaaggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2016 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgagtggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2017 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatgctccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2018 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2019 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgaatgctccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2020 - DNA, 648 bp, Artificial Sequence; identical to SEQ ID NO: 2019
  Description of Artificial Sequence: Synthetic polynucleotide

SEQ ID NO: 2021 - DNA, 648 bp, Artificial Sequence; identical to SEQ ID NO: 2008
  Description of Artificial Sequence: Synthetic polynucleotide

SEQ ID NO: 2022 - DNA, 642 bp, Artificial Sequence
  Description of Artificial Sequence: Synthetic polynucleotide
gacatccagatgacccagtctccatcctccctgtctgcatctataggagacagagtcaccatcacttgccgggcaagtcaggaccttagaaattatttaggctggtatcaacagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2023 - DNA, 642 bp, Artificial Sequence; identical to SEQ ID NO: 1906
  Description of Artificial Sequence: Synthetic polynucleotide

SEQ ID NO: 2024 - DNA, 648 bp, Artificial Sequence
  Description of Artificial Sequence: Synthetic polynucleotide
cagtctgtgctgactcagccaccctcagcgtctgggacccccgggcagagggtcaccatctcttgttctggaagtagctccaacatcggaagtaatactgtaaactggtaccagcaactcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgagtggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2025 - DNA, 642 bp, Artificial Sequence
  Description of Artificial Sequence: Synthetic polynucleotide
gacatccagctgacccagtctccatcctccctgtctgcatctgtaggagacagagtcactatcacttgccgggcaagtcagaccattagcaggtttttaaattggtatcagcagaaacctgggaaagcccctgagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcacacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2026 - DNA, 648 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggaaataattatgtatcctggtatgagcagttcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2027 - DNA, 642 bp, Artificial Sequence
  Description of Artificial Sequence: Synthetic polynucleotide
gacatccagctgacccagtctccatcctccctgtctgcatctgtaggagacagagtcactatcacttgccgggcaagtcagaccattagcaggtttttaaattggtatcagcagaaacctgggaaagcccctgagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2028 - DNA, 642 bp, Artificial Sequence; identical to SEQ ID NO: 2027
  Description of Artificial Sequence: Synthetic polynucleotide

SEQ ID NO: 2029 - DNA, 642 bp, Artificial Sequence; identical to SEQ ID NO: 2025
  Description of Artificial Sequence: Synthetic polynucleotide

SEQ ID NO: 2030 - DNA, 642 bp, Artificial Sequence
  Description of Artificial Sequence: Synthetic polynucleotide
gacatccagctgacccagtctccatcctccctgtctgcatctgtaggagacagagtcactatcacttgccgggcaagtcagaccattagcaggtttttaaattggtatcagcagaaacctgggaaagcccctaagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2031 - DNA, 642 bp, Artificial Sequence; identical to SEQ ID NO: 2027
  Description of Artificial Sequence: Synthetic polynucleotide

SEQ ID NO: 2032 - DNA, 642 bp, Artificial Sequence; identical to SEQ ID NO: 2027
  Description of Artificial Sequence: Synthetic polynucleotide

SEQ ID NO: 2033 - DNA, 648 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2034 - DNA, 648 bp, Artificial Sequence; identical to SEQ ID NO: 2033
  Description of Artificial Sequence: Synthetic polynucleotide

SEQ ID NO: 2035 - DNA, 648 bp, Artificial Sequence; identical to SEQ ID NO: 2026
  Description of Artificial Sequence: Synthetic polynucleotide

SEQ ID NO: 2036 - DNA, 648 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacattcgaaagcagcctgagtgctgtggtattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2037 - DNA, 648 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagcagcctgagtgctgtggtattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2038 - DNA, 648 bp, Artificial Sequence; identical to SEQ ID NO: 2037
  Description of Artificial Sequence: Synthetic polynucleotide

SEQ ID NO: 2039 - DNA, 648 bp, Artificial Sequence; identical to SEQ ID NO: 2033
  Description of Artificial Sequence: Synthetic polynucleotide

SEQ ID NO: 2040 - DNA, 648 bp, Artificial Sequence; identical to SEQ ID NO: 2036
  Description of Artificial Sequence: Synthetic polynucleotide

SEQ ID NO: 2041 - DNA, 642 bp, Artificial Sequence
  Description of Artificial Sequence: Synthetic polynucleotide
gacatccagctgacccagtctccatcctccctgtctgcatctgtaggagacagagtcactatcacttgccgggcaagtcagaccattagcaggtttttaaattggtatcagcagaaacctgggaaagcccctaagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgctcagttttggccaggggaccaagctggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2042 - DNA, 1374 bp, Artificial Sequence
  Description of Artificial Sequence: Synthetic polynucleotide
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcaggctgaggtctgacgacacggccgtgtattactgtgcgagagggggggattacgtttgggggacttatcggcctcactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2043 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatggaagtaatgaaaactatgcagactccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2044 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatggaagtaataaatactatgcagactccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2045 - DNA, 1350 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagcgacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2046 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2047 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgacagtggtggcacagactattcacagaggtttcagggcaggttcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2048 - DNA, 1359 bp, Artificial Sequence
  Description of Artificial Sequence: Synthetic polynucleotide
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgacacaagctatgcacagaagtttcaggacagggtcaccatgaccagggacacgtccatcagcacagcctatatggagctgagcagactgagatctgacgacacggccgtgtatttctgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2049 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgacacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2050 - DNA, 1368 bp, Artificial Sequence
  Description of Artificial Sequence: Synthetic polynucleotide
caggtgcagttgcaggagtcgggcccaggactggtgaagccttcacagaccctgtccctcacctgcactgtctctggtgactccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2051 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatggaagtgataaatactatgcagactccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2052 - DNA, 1353 bp, Artificial Sequence; identical to SEQ ID NO: 2044
  Description of Artificial Sequence: Synthetic polynucleotide

SEQ ID NO: 2053 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatggaaataataaatactatgcagactccgtgaagggccgattcaccatctccagagacagttccaagaacacgctgtatctgcaaatgaacagcctgagagccgaggacacggctgtgtattactgtgcgagagatcggacgatttttggagtggtccttgagtacctcggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2054 - DNA, 1341 bp, Artificial Sequence
  Description of Artificial Sequence: Synthetic polynucleotide
caggtgcagctgcaggagtcgggcccaggactggtgaagccttcggagaccctgtccctcacctgcactgtctctcagggctccatcagtagttactactggagctggatccggcagcccgccgggaagggactagagtggattggccgtatctataccagtgggagcaccaactacaacccctccctcaagagtcgagtcaccatgtcaatagacacgtccaagaaccagttctccctgaaactgaactctgtgaccgccgcggacacggccgtgtattactgtgcgagagatgtagcagtggctggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2055 - DNA, 1341 bp, Artificial Sequence
  Description of Artificial Sequence: Synthetic polynucleotide
caggtgcagctgcaggagtcgggcccaggactggtgaagccttcggagaccctgtccctcacctgcactgtctctgggggctccatcagtagttactactggagctggatccggcagcccgccgggaagggactagagtggattggccgtatctataccagtgggagcaccaactacaacccctccctcaagagtcgagtcaccatgtcaatagacacgtccaagaaccagttctccctgaaactgaactctgtgaccgccgcggacacggccgtgtattactgtgcgagagatgtagcagtggctggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2056 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagacgccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2057 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagactccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2058 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatggaagtaataaatactatgcagacgccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2059 - DNA, 1353 bp, Artificial Sequence; identical to SEQ ID NO: 2056
  Description of Artificial Sequence: Synthetic polynucleotide

SEQ ID NO: 2060 - DNA, 1353 bp, Artificial Sequence; identical to SEQ ID NO: 2056
  Description of Artificial Sequence: Synthetic polynucleotide

SEQ ID NO: 2061 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagacgccgtgaagggccgcttcaccatctccagagacaattccaagaacacgctgtatctgcaaatgaacagcctgagagccgaggacacggctgtgtattactgtgcgcgagataggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2062 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgcggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2063 - DNA, 1353 bp, Artificial Sequence; identical to SEQ ID NO: 2062
  Description of Artificial Sequence: Synthetic polynucleotide

SEQ ID NO: 2064 - DNA, 1353 bp, Artificial Sequence; identical to SEQ ID NO: 2062
  Description of Artificial Sequence: Synthetic polynucleotide

SEQ ID NO: 2065 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagactccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2066 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatggaagtaatgaaaactatgcagacgccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2067 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgaggacacggctgtgtattattgtgcgcgagataggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2068 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgaggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2069 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatggaagtaatgaaaactatgcagactccgtgaagggccgattcaccatctccagagacaattccaagaacacgctgtatctgcacatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2070 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2071 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcacatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2072 - DNA, 1353 bp, Artificial Sequence; identical to SEQ ID NO: 2070
  Description of Artificial Sequence: Synthetic polynucleotide

SEQ ID NO: 2073 - DNA, 1353 bp, Artificial Sequence; identical to SEQ ID NO: 2070
  Description of Artificial Sequence: Synthetic polynucleotide

SEQ ID NO: 2074 - DNA, 1353 bp, Artificial Sequence; identical to SEQ ID NO: 2071
  Description of Artificial Sequence: Synthetic polynucleotide

SEQ ID NO: 2075 - DNA, 1353 bp, Artificial Sequence; identical to SEQ ID NO: 2071
  Description of Artificial Sequence: Synthetic polynucleotide

SEQ ID NO: 2076 - DNA, 1353 bp, Artificial Sequence; identical to SEQ ID NO: 2070
  Description of Artificial Sequence: Synthetic polynucleotide

SEQ ID NO: 2077 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatggaagtaatgaaaactatgcagacgccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2078 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagactccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2079 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgaggacacggctgtgtattactgtgcgagagataggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2080 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgaggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2081 - DNA, 1350 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagacgccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2082 - DNA, 1350 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagacgccgtgaagggccgattcaccatctccagcgacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2083 - DNA, 1350 bp, Artificial Sequence; identical to SEQ ID NO: 2081
  Description of Artificial Sequence: Synthetic polynucleotide

SEQ ID NO: 2084 - DNA, 1350 bp, Artificial Sequence; identical to SEQ ID NO: 2081
  Description of Artificial Sequence: Synthetic polynucleotide

SEQ ID NO: 2085 - DNA, 1350 bp, Artificial Sequence; identical to SEQ ID NO: 2082
  Description of Artificial Sequence: Synthetic polynucleotide

SEQ ID NO: 2086 - DNA, 1350 bp, Artificial Sequence; identical to SEQ ID NO: 2082
  Description of Artificial Sequence: Synthetic polynucleotide

SEQ ID NO: 2087 - DNA, 1350 bp, Artificial Sequence; identical to SEQ ID NO: 2081
  Description of Artificial Sequence: Synthetic polynucleotide

SEQ ID NO: 2088 - DNA, 1350 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagactccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2089 - DNA, 1350 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagacgccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2090 - DNA, 1353 bp, Artificial Sequence; identical to SEQ ID NO: 2056
  Description of Artificial Sequence: Synthetic polynucleotide

SEQ ID NO: 2091 - DNA, 1353 bp, Artificial Sequence; identical to SEQ ID NO: 2061
  Description of Artificial Sequence: Synthetic polynucleotide

SEQ ID NO: 2092 - DNA, 1353 bp, Artificial Sequence; identical to SEQ ID NO: 2056
  Description of Artificial Sequence: Synthetic polynucleotide

SEQ ID NO: 2093 - DNA, 1353 bp, Artificial Sequence; identical to SEQ ID NO: 2061
  Description of Artificial Sequence: Synthetic polynucleotide

SEQ ID NO: 2094 - DNA, 1353 bp, Artificial Sequence; identical to SEQ ID NO: 2044
  Description of Artificial Sequence: Synthetic polynucleotide

SEQ ID NO: 2095 - DNA, 1353 bp, Artificial Sequence; identical to SEQ ID NO: 2057
  Description of Artificial Sequence: Synthetic polynucleotide

SEQ ID NO: 2096 - DNA, 1353 bp, Artificial Sequence; identical to SEQ ID NO: 2058
  Description of Artificial Sequence: Synthetic polynucleotide

SEQ ID NO: 2097 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2098 - DNA, 1350 bp, Artificial Sequence; identical to SEQ ID NO: 2097
  Description of Artificial Sequence: Synthetic polynucleotide

SEQ ID NO: 2099 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtacctcggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2100 - DNA, 1350 bp, Artificial Sequence; identical to SEQ ID NO: 2097
  Description of Artificial Sequence: Synthetic polynucleotide

SEQ ID NO: 2101 - DNA, 1350 bp, Artificial Sequence; identical to SEQ ID NO: 2099
  Description of Artificial Sequence: Synthetic polynucleotide

SEQ ID NO: 2102 - DNA, 1350 bp, Artificial Sequence; identical to SEQ ID NO: 2099
  Description of Artificial Sequence: Synthetic polynucleotide

SEQ ID NO: 2103 - DNA, 1350 bp, Artificial Sequence; identical to SEQ ID NO: 2097
  Description of Artificial Sequence: Synthetic polynucleotide

SEQ ID NO: 2104 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatggaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2105 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagactccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2106 - DNA, 1350 bp, Artificial Sequence; identical to SEQ ID NO: 2097
  Description of Artificial Sequence: Synthetic polynucleotide

SEQ ID NO: 2107 - DNA, 1350 bp, Artificial Sequence; identical to SEQ ID NO: 2099
  Description of Artificial Sequence: Synthetic polynucleotide

SEQ ID NO: 2108 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatgcaagtaataaatactatgaagacgccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2109 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatggaagtaataaatactatgaagactccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2110 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatggaagtaataaatactatgaagacgccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2111 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatgcaagtaataaatactatgaagactccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2112 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2113 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagactccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2114 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatggaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2115 - DNA, 1350 bp, Artificial Sequence; identical to SEQ ID NO: 2112
  Description of Artificial Sequence: Synthetic polynucleotide

SEQ ID NO: 2116 - DNA, 1350 bp, Artificial Sequence
  Description of Artificial Sequence: Synthetic polynucleotide
caggtgcagctggtggagtctgggggaggcgtggtccagcctgggaggtccctgagactctcctgtgcagcatctggattcaccttcagtaactatggcatgcactgggtccgccaggctccaggcaaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2117 - DNA, 1350 bp, Artificial Sequence; identical to SEQ ID NO: 2116
  Description of Artificial Sequence: Synthetic polynucleotide

SEQ ID NO: 2118 - DNA, 1350 bp, Artificial Sequence; identical to SEQ ID NO: 2112
  Description of Artificial Sequence: Synthetic polynucleotide

SEQ ID NO: 2119 - DNA, 1350 bp, Artificial Sequence; identical to SEQ ID NO: 2116
  Description of Artificial Sequence: Synthetic polynucleotide

SEQ ID NO: 2120 - DNA, 1368 bp, Artificial Sequence
  Description of Artificial Sequence: Synthetic polynucleotide
caggtgcagttgcaggagtcgggcccaggactggtgaagccttcagagaccctgtccctcacctgcactgtctctggtgactccatcagcagtggtggttactactggagctggatccgccagcccccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2121 - DNA, 1368 bp, Artificial Sequence; identical to SEQ ID NO: 2120
  Description of Artificial Sequence: Synthetic polynucleotide

SEQ ID NO: 2122 - DNA, 1368 bp, Artificial Sequence
  Description of Artificial Sequence: Synthetic polynucleotide
caggtgcagttgcaggagtcgggcccaggactggtgaagccttcacagaccctgtccctcacctgcactgtctctggtgactccatcagcagtggtggttactactggagctggatccgccagcccccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2123 - DNA, 1368 bp, Artificial Sequence
  Description of Artificial Sequence: Synthetic polynucleotide
caggtgcagttgcaggagtcgggcccaggactggtgaagccttcagagaccctgtccctcacctgcactgtctctggtgactccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2124 - DNA, 1368 bp, Artificial Sequence; identical to SEQ ID NO: 2050
  Description of Artificial Sequence: Synthetic polynucleotide

SEQ ID NO: 2125 - DNA, 1368 bp, Artificial Sequence; identical to SEQ ID NO: 2123
  Description of Artificial Sequence: Synthetic polynucleotide

SEQ ID NO: 2126 - DNA, 1368 bp, Artificial Sequence; identical to SEQ ID NO: 2122
  Description of Artificial Sequence: Synthetic polynucleotide

SEQ ID NO: 2127 - DNA, 1359 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2128 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2129 - DNA, 1359 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2130 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2131 - DNA, 1359 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2132 - DNA, 1359 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2133 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2134 - DNA, 1359 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2135 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2136 - DNA, 1359 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacagcctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2137 - DNA, 1359 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcagggtcaccatgaccagggacacgtccatcagcacagcctacatggaactgaacagcctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2138 - DNA, 1359 bp, Artificial Sequence
  Description of Artificial Sequence: Synthetic polynucleotide
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2139 - DNA, 1359 bp, Artificial Sequence
  Description of Artificial Sequence: Synthetic polynucleotide
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgacacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2140 - DNA, 1359 bp, Artificial Sequence; identical to SEQ ID NO: 2138
  Description of Artificial Sequence: Synthetic polynucleotide

SEQ ID NO: 2141 - DNA, 1359 bp, Artificial Sequence
  Description of Artificial Sequence: Synthetic polynucleotide
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2142 - DNA, 1359 bp, Artificial Sequence; identical to SEQ ID NO: 2048
  Description of Artificial Sequence: Synthetic polynucleotide

SEQ ID NO: 2143 - DNA, 1359 bp, Artificial Sequence; identical to SEQ ID NO: 2141
  Description of Artificial Sequence: Synthetic polynucleotide

SEQ ID NO: 2144 - DNA, 1359 bp, Artificial Sequence; identical to SEQ ID NO: 2139
  Description of Artificial Sequence: Synthetic polynucleotide

SEQ ID NO: 2145 - DNA, 1359 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacaccttcaccggctactatatacactgggtgcgtcaggcccctggacaagggcttgagtggatggggtggatcagccctaacagtggtgaaacaagctatgcacagaagtttcaggacagggtcaccatgaccagggacacgtccatcagcacagcctatatggagctgagcagcctgagatctgacgacacggccgtgtatttctgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2146 - DNA, 1359 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacaccttcaccggctactatatacactgggtgcgtcaggcccctggacaagggcttgagtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2147 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcagggtcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2148 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcaggttcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2149 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgacagtggtggcacagactattcacagaggtttcagggcagggtcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2150 - DNA, 1359 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcagggtcaccatgaccagggacacgtccatcagcacagcctacatggaactgagcagcctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2151 - DNA, 1359 bp, Artificial Sequence; identical to SEQ ID NO: 2147
  Description of Artificial Sequence: Synthetic polynucleotide

SEQ ID NO: 2152 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2153 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgacacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2154 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2155 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgaaacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2156 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgacacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2157 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgacacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2158 - DNA, 1359 bp, Artificial Sequence
  Description of Artificial Sequence: Synthetic polynucleotide
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgaaacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2159 - DNA, 1359 bp, Artificial Sequence; identical to SEQ ID NO: 2152
  Description of Artificial Sequence: Synthetic polynucleotide

SEQ ID NO: 2160 - DNA, 1359 bp, Artificial Sequence; identical to SEQ ID NO: 2156
  Description of Artificial Sequence: Synthetic polynucleotide

SEQ ID NO: 2161 - DNA, 1359 bp, Artificial Sequence; identical to SEQ ID NO: 2153
  Description of Artificial Sequence: Synthetic polynucleotide

SEQ ID NO: 2162 - DNA, 1359 bp, Artificial Sequence; identical to SEQ ID NO: 2155
  Description of Artificial Sequence: Synthetic polynucleotide

SEQ ID NO: 2163 - DNA, 1359 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcagcctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2164 - DNA, 1359 bp, Artificial Sequence; identical to SEQ ID NO: 2163
  Description of Artificial Sequence: Synthetic polynucleotide

SEQ ID NO: 2165 - DNA, 1374 bp, Artificial Sequence; identical to SEQ ID NO: 2042
  Description of Artificial Sequence: Synthetic polynucleotide

SEQ ID NO: 2166 - DNA, 1374 bp, Artificial Sequence; identical to SEQ ID NO: 2042
  Description of Artificial Sequence: Synthetic polynucleotide

SEQ ID NO: 2167 - DNA, 1374 bp, Artificial Sequence; identical to SEQ ID NO: 2042
  Description of Artificial Sequence: Synthetic polynucleotide

SEQ ID NO: 2168 - DNA, 1374 bp, Artificial Sequence; identical to SEQ ID NO: 2042
  Description of Artificial Sequence: Synthetic polynucleotide

SEQ ID NO: 2169 - DNA, 1374 bp, Artificial Sequence; identical to SEQ ID NO: 2042
  Description of Artificial Sequence: Synthetic polynucleotide

SEQ ID NO: 2170 - DNA, 1374 bp, Artificial Sequence; identical to SEQ ID NO: 2042
  Description of Artificial Sequence: Synthetic polynucleotide

SEQ ID NO: 2171 - DNA, 1374 bp, Artificial Sequence; identical to SEQ ID NO: 2042
  Description of Artificial Sequence: Synthetic polynucleotide

SEQ ID NO: 2172 - DNA, 1374 bp, Artificial Sequence; identical to SEQ ID NO: 2042
  Description of Artificial Sequence: Synthetic polynucleotide

SEQ ID NO: 2173 - DNA, 1374 bp, Artificial Sequence; identical to SEQ ID NO: 2042
  Description of Artificial Sequence: Synthetic polynucleotide

SEQ ID NO: 2174 - DNA, 1374 bp, Artificial Sequence; identical to SEQ ID NO: 2042
  Description of Artificial Sequence: Synthetic polynucleotide

SEQ ID NO: 2175 - DNA, 1374 bp, Artificial Sequence; identical to SEQ ID NO: 2042
  Description of Artificial Sequence: Synthetic polynucleotide

SEQ ID NO: 2176 - DNA, 1374 bp, Artificial Sequence; identical to SEQ ID NO: 2042
  Description of Artificial Sequence: Synthetic polynucleotide

SEQ ID NO: 2177 - DNA, 1374 bp, Artificial Sequence
  Description of Artificial Sequence: Synthetic polynucleotide
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcagcctgaggtctgacgacacggccgtgtattactgtgcgagagggggggattacgttttcgggacttatcggcctcactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2178 - DNA, 1374 bp, Artificial Sequence
  Description of Artificial Sequence: Synthetic polynucleotide
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcaggctgaggtctgacgacacggccgtgtattactgtgcgagagggggggattacgttttcgggacttatcggcctcactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2179 - DNA, 1353 bp, Artificial Sequence; identical to SEQ ID NO: 2079
  Description of Artificial Sequence: Synthetic polynucleotide

SEQ ID NO: 2180 - DNA, 1353 bp, Artificial Sequence; identical to SEQ ID NO: 2061
  Description of Artificial Sequence: Synthetic polynucleotide

SEQ ID NO: 2181 - DNA, 1374 bp, Artificial Sequence; identical to SEQ ID NO: 2042
  Description of Artificial Sequence: Synthetic polynucleotide

SEQ ID NO: 2182 - DNA, 1353 bp, Artificial Sequence
  Description of Artificial Sequence: Synthetic polynucleotide
caggtgcagttggtggagtctgggggaggcgtggtccagcctgggaggtccctgagactctcctgtacagcgtctggattcaccttcagtagctatggcatacactgggtccgccaggctccaggcaaggggctggagtgggtggcagttatatggtatgatggaagtaataagttccatgcagactccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2183 - DNA, 1377 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccagggacacctccataagcacagcctacatggagctgagcagcctgagatctcaggacacggccgtgtattactgtgcgagagggggtgattacgtttgggggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2184 - DNA, 1353 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2185 - DNA, 1353 bp, Artificial Sequence
  Description of Artificial Sequence: Synthetic polynucleotide
caggtgcagttggtggagtctgggggaggcgtggtccagcctgggaggtccctgagactctcctgtacagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2186 - DNA, 1353 bp, Artificial Sequence; identical to SEQ ID NO: 2184
  Description of Artificial Sequence: Synthetic polynucleotide

SEQ ID NO: 2187 - DNA, 1353 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacattggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2188 - DNA, 1353 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagactccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2189 - DNA, 1353 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatggaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2190 - DNA, 1377 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtggcacaggctatgcacagaagttccagggcagagtcaccatgaccagggacacctccataagcacagcctacatggagctgagcagcctgagatctcaggacacggccgtgtattactgtgcgagagggggtgattacgtttgggggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2191 - DNA, 1377 bp, Artificial Sequence; identical to SEQ ID NO: 2183
  Description of Artificial Sequence: Synthetic polynucleotide

SEQ ID NO: 2192 - DNA, 1377 bp, Artificial Sequence; identical to SEQ ID NO: 2190
  Description of Artificial Sequence: Synthetic polynucleotide

SEQ ID NO: 2193 - DNA, 1377 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtggcacaggctatgcacagaagttccagggcagagtcaccatgaccagggacacctccataagcacagcctacatggagctgagcagcctgagatctgacgacacggccgtgtattactgtgcgagagggggtgattacgtttgggggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2194 - DNA, 1377 bp, Artificial Sequence; identical to SEQ ID NO: 2190
  Description of Artificial Sequence: Synthetic polynucleotide

SEQ ID NO: 2195 - DNA, 1377 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtaacacaggctatgcacagaagttccagggcagagtcaccatgaccagggacacctccataagcacagcctacatggagctgagcagcctgagatctgacgacacggccgtgtattactgtgcgagagggggtgattacgtttgggggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2196 - DNA, 1377 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtggcacaggctatgcacagaagttccagggcagagtcaccatgaccagggacacctccataagcacagcctacatggagctgagcagcctgagatctcaggacacggccgtgtattactgtgcgagagggggtgattacgttttcgggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2197 - DNA, 1377 bp, Artificial Sequence
  Description of Artificial Sequence: Synthetic polynucleotide
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtggcacaggctatgcacagaagttccagggcagagtcaccatgaccagggacacctccataagcacagcctacatggagctgagcagcctgagatctgacgacacggccgtgtattactgtgcgagagggggtgattacgttttcgggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2198 - DNA, 1353 bp, Artificial Sequence; identical to SEQ ID NO: 2187
  Description of Artificial Sequence: Synthetic polynucleotide

SEQ ID NO: 2199 - DNA, 39 bp, Artificial Sequence
  Description of Artificial Sequence: Synthetic oligonucleotide
tctggaagtagctccaacatcggaagtaatactgtaaac

SEQ ID NO: 2200 - DNA, 33 bp, Artificial Sequence
  Description of Artificial Sequence: Synthetic oligonucleotide
cgggcaagtcaggacattagagattatttaggc

SEQ ID NO: 2201 - DNA, 33 bp, Artificial Sequence; identical to SEQ ID NO: 2200
  Description of Artificial Sequence: Synthetic oligonucleotide

SEQ ID NO: 2202 - DNA, 33 bp, Artificial Sequence
  Description of Artificial Sequence: Synthetic oligonucleotide
caggcgagtcaggacattagcaactatttaaat

SEQ ID NO: 2203 - DNA, 51 bp, Artificial Sequence
  Description of Artificial Sequence: Synthetic oligonucleotide
aagtccagccagagtgttttatccagctccaacaataagaactacatagct

SEQ ID NO: 2204 - DNA, 51 bp, Artificial Sequence; identical to SEQ ID NO: 2203
  Description of Artificial Sequence: Synthetic oligonucleotide

SEQ ID NO: 2205 - DNA, 51 bp, Artificial Sequence
  Description of Artificial Sequence: Synthetic oligonucleotide
aagtccagccagagtgttttatccagctccaacaataagaactacttagct

SEQ ID NO: 2206 - DNA, 51 bp, Artificial Sequence; identical to SEQ ID NO: 2205
  Description of Artificial Sequence: Synthetic oligonucleotide

SEQ ID NO: 2207 - DNA, 36 bp, Artificial Sequence
  Description of Artificial Sequence: Synthetic oligonucleotide
agggccagtcagagtattagttacagttacttagcc

SEQ ID NO: 2208 - DNA, 33 bp, Artificial Sequence
  Description of Artificial Sequence: Synthetic oligonucleotide
agggccagtcagagtgttagcagcaacttagcc

SEQ ID NO: 2209 - DNA, 33 bp, Artificial Sequence
  Description of Artificial Sequence: Synthetic oligonucleotide
cgggcaagtcagggcattagaaatgagttaggc

SEQ ID NO: 2210 - DNA, 33 bp, Artificial Sequence
  Description of Artificial Sequence: Synthetic oligonucleotide
caggcgagtcaggacattaccaactatttaaat

SEQ ID NO: 2211 - DNA, 33 bp, Artificial Sequence
  Description of Artificial Sequence: Synthetic oligonucleotide
cgggcgagtcagggtcttatcatctggttagcc

SEQ ID NO: 2212 - DNA, 33 bp, Artificial Sequence; identical to SEQ ID NO: 2211
  Description of Artificial Sequence: Synthetic oligonucleotide

SEQ ID NO: 2213 - DNA, 33 bp, Artificial Sequence; identical to SEQ ID NO: 2209
  Description of Artificial Sequence: Synthetic oligonucleotide

SEQ ID NO: 2214 - DNA, 33 bp, Artificial Sequence; identical to SEQ ID NO: 2209
  Description of Artificial Sequence: Synthetic oligonucleotide

SEQ ID NO: 2215 - DNA, 33 bp, Artificial Sequence; identical to SEQ ID NO: 2209
  Description of Artificial Sequence: Synthetic oligonucleotide

SEQ ID NO: 2216 - DNA, 33 bp, Artificial Sequence; identical to SEQ ID NO: 2209
  Description of Artificial Sequence: Synthetic oligonucleotide

SEQ ID NO: 2217 - DNA, 33 bp, Artificial Sequence; identical to SEQ ID NO: 2209
  Description of Artificial Sequence: Synthetic oligonucleotide

SEQ ID NO: 2218 - DNA, 33 bp, Artificial Sequence; identical to SEQ ID NO: 2209
  Description of Artificial Sequence: Synthetic oligonucleotide

SEQ ID NO: 2219 - DNA, 33 bp, Artificial Sequence; identical to SEQ ID NO: 2200
  Description of Artificial Sequence: Synthetic oligonucleotide

SEQ ID NO: 2220 - DNA, 33 bp, Artificial Sequence; identical to SEQ ID NO: 2200
  Description of Artificial Sequence: Synthetic oligonucleotide

SEQ ID NO: 2221 - DNA, 33 bp, Artificial Sequence; identical to SEQ ID NO: 2200
  Description of Artificial Sequence: Synthetic oligonucleotide

SEQ ID NO: 2222 - DNA, 33 bp, Artificial Sequence; identical to SEQ ID NO: 2200
  Description of Artificial Sequence: Synthetic oligonucleotide

SEQ ID NO: 2223 - DNA, 33 bp, Artificial Sequence; identical to SEQ ID NO: 2200
  Description of Artificial Sequence: Synthetic oligonucleotide

SEQ ID NO: 2224 - DNA, 33 bp, Artificial Sequence; identical to SEQ ID NO: 2200
  Description of Artificial Sequence: Synthetic oligonucleotide

SEQ ID NO: 2225 - DNA, 33 bp, Artificial Sequence; identical to SEQ ID NO: 2200
  Description of Artificial Sequence: Synthetic oligonucleotide

SEQ ID NO: 2226 - DNA, 33 bp, Artificial Sequence
  Description of Artificial Sequence: Synthetic oligonucleotide
cgggcaagtcaggaccttagaaattatttaggc

SEQ ID NO: 2227 - DNA, 33 bp, Artificial Sequence; identical to SEQ ID NO: 2226
  Description of Artificial Sequence: Synthetic oligonucleotide

SEQ ID NO: 2228 - DNA, 33 bp, Artificial Sequence; identical to SEQ ID NO: 2226
  Description of Artificial Sequence: Synthetic oligonucleotide

SEQ ID NO: 2229 - DNA, 33 bp, Artificial Sequence; identical to SEQ ID NO: 2226
  Description of Artificial Sequence: Synthetic oligonucleotide

SEQ ID NO: 2230 - DNA, 33 bp, Artificial Sequence; identical to SEQ ID NO: 2226
  Description of Artificial Sequence: Synthetic oligonucleotide

SEQ ID NO: 2231 - DNA, 33 bp, Artificial Sequence; identical to SEQ ID NO: 2226
  Description of Artificial Sequence: Synthetic oligonucleotide

SEQ ID NO: 2232 - DNA, 33 bp, Artificial Sequence; identical to SEQ ID NO: 2226
  Description of Artificial Sequence: Synthetic oligonucleotide

SEQ ID NO: 2233 - DNA, 33 bp, Artificial Sequence; identical to SEQ ID NO: 2226
  Description of Artificial Sequence: Synthetic oligonucleotide

SEQ ID NO: 2234 - DNA, 33 bp, Artificial Sequence; identical to SEQ ID NO: 2226
  Description of Artificial Sequence: Synthetic oligonucleotide

SEQ ID NO: 2235 - DNA, 33 bp, Artificial Sequence; identical to SEQ ID NO: 2226
  Description of Artificial Sequence: Synthetic oligonucleotide

SEQ ID NO: 2236 - DNA, 33 bp, Artificial Sequence; identical to SEQ ID NO: 2226
  Description of Artificial Sequence: Synthetic oligonucleotide

SEQ ID NO: 2237 - DNA, 33 bp, Artificial Sequence; identical to SEQ ID NO: 2226
  Description of Artificial Sequence: Synthetic oligonucleotide

SEQ ID NO: 2238 - DNA, 33 bp, Artificial Sequence; identical to SEQ ID NO: 2202
  Description of Artificial Sequence: Synthetic oligonucleotide

SEQ ID NO: 2239 - DNA, 33 bp, Artificial Sequence; identical to SEQ ID NO: 2202
  Description of Artificial Sequence: Synthetic oligonucleotide

SEQ ID NO: 2240 - DNA, 33 bp, Artificial Sequence; identical to SEQ ID NO: 2202
  Description of Artificial Sequence: Synthetic oligonucleotide

SEQ ID NO: 2241 - DNA, 33 bp, Artificial Sequence; identical to SEQ ID NO: 2202
  Description of Artificial Sequence: Synthetic oligonucleotide

SEQ ID NO: 2242 - DNA, 33 bp, Artificial Sequence; identical to SEQ ID NO: 2202
  Description of Artificial Sequence: Synthetic oligonucleotide

SEQ ID NO: 2243 - DNA, 33 bp, Artificial Sequence; identical to SEQ ID NO: 2202
  Description of Artificial Sequence: Synthetic oligonucleotide

SEQ ID NO: 2244 - DNA, 33 bp, Artificial Sequence; identical to SEQ ID NO: 2202
  Description of Artificial Sequence: Synthetic oligonucleotide

SEQ ID NO: 2245 - DNA, 33 bp, Artificial Sequence; identical to SEQ ID NO: 2202
  Description of Artificial Sequence: Synthetic oligonucleotide

SEQ ID NO: 2246 - DNA, 33 bp, Artificial Sequence; identical to SEQ ID NO: 2202
  Description of Artificial Sequence: Synthetic oligonucleotide

SEQ ID NO: 2247 - DNA, 33 bp, Artificial Sequence; identical to SEQ ID NO: 2200
  Description of Artificial Sequence: Synthetic oligonucleotide

SEQ ID NO: 2248 - DNA, 33 bp, Artificial Sequence; identical to SEQ ID NO: 2200
  Description of Artificial Sequence: Synthetic oligonucleotide

SEQ ID NO: 2249 - DNA, 33 bp, Artificial Sequence; identical to SEQ ID NO: 2200
  Description of Artificial Sequence: Synthetic oligonucleotide

SEQ ID NO: 2250 - DNA, 33 bp, Artificial Sequence; identical to SEQ ID NO: 2200
  Description of Artificial Sequence: Synthetic oligonucleotide

SEQ ID NO: 2251 - DNA, 33 bp, Artificial Sequence; identical to SEQ ID NO: 2200
  Description of Artificial Sequence: Synthetic oligonucleotide

SEQ ID NO: 2252 - DNA, 33 bp, Artificial Sequence; identical to SEQ ID NO: 2200
  Description of Artificial Sequence: Synthetic oligonucleotide

SEQ ID NO: 2253 - DNA, 33 bp, Artificial Sequence; identical to SEQ ID NO: 2200
  Description of Artificial Sequence: Synthetic oligonucleotide

SEQ ID NO: 2254 - DNA, 33 bp, Artificial Sequence; identical to SEQ ID NO: 2210
  Description of Artificial Sequence: Synthetic oligonucleotide

SEQ ID NO: 2255 - DNA, 33 bp, Artificial Sequence; identical to SEQ ID NO: 2210
  Description of Artificial Sequence: Synthetic oligonucleotide

SEQ ID NO: 2256 - DNA, 33 bp, Artificial Sequence; identical to SEQ ID NO: 2210
  Description of Artificial Sequence: Synthetic oligonucleotide

SEQ ID NO: 2257 - DNA, 33 bp, Artificial Sequence; identical to SEQ ID NO: 2210
  Description of Artificial Sequence: Synthetic oligonucleotide

SEQ ID NO: 2258 - DNA, 33 bp, Artificial Sequence; identical to SEQ ID NO: 2210
  Description of Artificial Sequence: Synthetic oligonucleotide

SEQ ID NO: 2259 - DNA, 33 bp, Artificial Sequence; identical to SEQ ID NO: 2210
  Description of Artificial Sequence: Synthetic oligonucleotide

SEQ ID NO: 2260 - DNA, 33 bp, Artificial Sequence; identical to SEQ ID NO: 2210
  Description of Artificial Sequence: Synthetic oligonucleotide

SEQ ID NO: 2261 - DNA, 33 bp, Artificial Sequence; identical to SEQ ID NO: 2210
  Description of Artificial Sequence: Synthetic oligonucleotide

SEQ ID NO: 2262 - DNA, 33 bp, Artificial Sequence; identical to SEQ ID NO: 2210
  Description of Artificial Sequence: Synthetic oligonucleotide

SEQ ID NO: 2263 - DNA, 33 bp, Artificial Sequence; identical to SEQ ID NO: 2210
  Description of Artificial Sequence: Synthetic oligonucleotide

SEQ ID NO: 2264 - DNA, 33 bp, Artificial Sequence; identical to SEQ ID NO: 2210
  Description of Artificial Sequence: Synthetic oligonucleotide

SEQ ID NO: 2265 - DNA, 36 bp, Artificial Sequence
  Description of Artificial Sequence: Synthetic oligonucleotide
agggccagtcagatttttaccagcacctacttagcc

SEQ ID NO: 2266 - DNA, 36 bp, Artificial Sequence; identical to SEQ ID NO: 2265
  Description of Artificial Sequence: Synthetic oligonucleotide

SEQ ID NO: 2267 - DNA, 36 bp, Artificial Sequence; identical to SEQ ID NO: 2265
  Description of Artificial Sequence: Synthetic oligonucleotide

SEQ ID NO: 2268 - DNA, 36 bp, Artificial Sequence; identical to SEQ ID NO: 2265
  Description of Artificial Sequence: Synthetic oligonucleotide

SEQ ID NO: 2269 - DNA, 33 bp, Artificial Sequence; identical to SEQ ID NO: 2208
  Description of Artificial Sequence: Synthetic oligonucleotide

SEQ ID NO: 2270 - DNA, 33 bp, Artificial Sequence; identical to SEQ ID NO: 2208
  Description of Artificial Sequence: Synthetic oligonucleotide

SEQ ID NO: 2271 - DNA, 33 bp, Artificial Sequence; identical to SEQ ID NO: 2208
  Description of Artificial Sequence: Synthetic oligonucleotide

SEQ ID NO: 2272 - DNA, 33 bp, Artificial Sequence; identical to SEQ ID NO: 2208
  Description of Artificial Sequence: Synthetic oligonucleotide

SEQ ID NO: 2273 - DNA, 33 bp, Artificial Sequence; identical to SEQ ID NO: 2208
  Description of Artificial Sequence: Synthetic oligonucleotide

SEQ ID NO: 2274 - DNA, 33 bp, Artificial Sequence; identical to SEQ ID NO: 2208
  Description of Artificial Sequence: Synthetic oligonucleotide

SEQ ID NO: 2275 - DNA, 33 bp, Artificial Sequence; identical to SEQ ID NO: 2208
  Description of Artificial Sequence: Synthetic oligonucleotide

SEQ ID NO: 2276 - DNA, 33 bp, Artificial Sequence; identical to SEQ ID NO: 2208
  Description of Artificial Sequence: Synthetic oligonucleotide

SEQ ID NO: 2277 - DNA, 36 bp, Artificial Sequence; identical to SEQ ID NO: 2207
  Description of Artificial Sequence: Synthetic oligonucleotide

SEQ ID NO: 2278 - DNA, 36 bp, Artificial Sequence; identical to SEQ ID NO: 2207
  Description of Artificial Sequence: Synthetic oligonucleotide

SEQ ID NO: 2279 - DNA, 36 bp, Artificial Sequence; identical to SEQ ID NO: 2207
  Description of Artificial Sequence: Synthetic oligonucleotide

SEQ ID NO: 2280 - DNA, 36 bp, Artificial Sequence; identical to SEQ ID NO: 2207
  Description of Artificial Sequence: Synthetic oligonucleotide

SEQ ID NO: 2281 - DNA, 36 bp, Artificial Sequence; identical to SEQ ID NO: 2207
  Description of Artificial Sequence: Synthetic oligonucleotide

SEQ ID NO: 2282 - DNA, 36 bp, Artificial Sequence; identical to SEQ ID NO: 2207
  Description of Artificial Sequence: Synthetic oligonucleotide

SEQ ID NO: 2283 - DNA, 36 bp, Artificial Sequence; identical to SEQ ID NO: 2207
  Description of Artificial Sequence: Synthetic oligonucleotide

SEQ ID NO: 2284 - DNA, 51 bp, Artificial Sequence; identical to SEQ ID NO: 2203
  Description of Artificial Sequence: Synthetic oligonucleotide

SEQ ID NO: 2285 - DNA, 51 bp, Artificial Sequence; identical to SEQ ID NO: 2203
  Description of Artificial Sequence: Synthetic oligonucleotide

SEQ ID NO: 2286 - DNA, 51 bp, Artificial Sequence; identical to SEQ ID NO: 2203
  Description of Artificial Sequence: Synthetic oligonucleotide

SEQ ID NO: 2287 - DNA, 51 bp, Artificial Sequence; identical to SEQ ID NO: 2203
  Description of Artificial Sequence: Synthetic oligonucleotide

SEQ ID NO: 2288 - DNA, 51 bp, Artificial Sequence; identical to SEQ ID NO: 2203
  Description of Artificial Sequence: Synthetic oligonucleotide

SEQ ID NO: 2289 - DNA, 51 bp, Artificial Sequence; identical to SEQ ID NO: 2203
  Description of Artificial Sequence: Synthetic oligonucleotide

SEQ ID NO: 2290 - DNA, 51 bp, Artificial Sequence; identical to SEQ ID NO: 2203
  Description of Artificial Sequence: Synthetic oligonucleotide

SEQ ID NO: 2291 - DNA, 51 bp, Artificial Sequence; identical to SEQ ID NO: 2203
  Description of Artificial Sequence: Synthetic oligonucleotide

SEQ ID NO: 2292 - DNA, 51 bp, Artificial Sequence; identical to SEQ ID NO: 2203
  Description of Artificial Sequence: Synthetic oligonucleotide

SEQ ID NO: 2293 - DNA, 51 bp, Artificial Sequence; identical to SEQ ID NO: 2203
  Description of Artificial Sequence: Synthetic oligonucleotide

SEQ ID NO: 2294 - DNA, 51 bp, Artificial Sequence; identical to SEQ ID NO: 2203
  Description of Artificial Sequence: Synthetic oligonucleotide

SEQ ID NO: 2295 - DNA, 51 bp, Artificial Sequence; identical to SEQ ID NO: 2205
  Description of Artificial Sequence: Synthetic oligonucleotide

SEQ ID NO: 2296 - DNA, 51 bp, Artificial Sequence; identical to SEQ ID NO: 2205
  Description of Artificial Sequence: Synthetic oligonucleotide

SEQ ID NO: 2297 - DNA, 51 bp, Artificial Sequence; identical to SEQ ID NO: 2205
  Description of Artificial Sequence: Synthetic oligonucleotide

SEQ ID NO: 2298 - DNA, 51 bp, Artificial Sequence; identical to SEQ ID NO: 2205
  Description of Artificial Sequence: Synthetic oligonucleotide

SEQ ID NO: 2299 - DNA, 51 bp, Artificial Sequence; identical to SEQ ID NO: 2205
  Description of Artificial Sequence: Synthetic oligonucleotide

SEQ ID NO: 2300 - DNA, 51 bp, Artificial Sequence; identical to SEQ ID NO: 2205
  Description of Artificial Sequence: Synthetic oligonucleotide

SEQ ID NO: 2301 - DNA, 51 bp, Artificial Sequence; identical to SEQ ID NO: 2205
  Description of Artificial Sequence: Synthetic oligonucleotide

SEQ ID NO: 2302 - DNA, 51 bp, Artificial Sequence; identical to SEQ ID NO: 2205
  Description of Artificial Sequence: Synthetic oligonucleotide

SEQ ID NO: 2303 - DNA, 51 bp, Artificial Sequence; identical to SEQ ID NO: 2205
  Description of Artificial Sequence: Synthetic oligonucleotide

SEQ ID NO: 2304 - DNA, 51 bp, Artificial Sequence; identical to SEQ ID NO: 2203
  Description of Artificial Sequence: Synthetic oligonucleotide

SEQ ID NO: 2305 - DNA, 51 bp, Artificial Sequence; identical to SEQ ID NO: 2203
  Description of Artificial Sequence: Synthetic oligonucleotide

SEQ ID NO: 2306 - DNA, 51 bp, Artificial Sequence; identical to SEQ ID NO: 2203
  Description of Artificial Sequence: Synthetic oligonucleotide

SEQ ID NO: 2307 - DNA, 51 bp, Artificial Sequence; identical to SEQ ID NO: 2203
  Description of Artificial Sequence: Synthetic oligonucleotide

SEQ ID NO: 2308 - DNA, 51 bp, Artificial Sequence; identical to SEQ ID NO: 2203
  Description of Artificial Sequence: Synthetic oligonucleotide

SEQ ID NO: 2309 - DNA, 51 bp, Artificial Sequence; identical to SEQ ID NO: 2205
  Description of Artificial Sequence: Synthetic oligonucleotide

SEQ ID NO: 2310 - DNA, 51 bp, Artificial Sequence; identical to SEQ ID NO: 2205
  Description of Artificial Sequence: Synthetic oligonucleotide

SEQ ID NO: 2311 - DNA, 51 bp, Artificial Sequence; identical to SEQ ID NO: 2205
  Description of Artificial Sequence: Synthetic oligonucleotide

SEQ ID NO: 2312 - DNA, 51 bp, Artificial Sequence; identical to SEQ ID NO: 2205
  Description of Artificial Sequence: Synthetic oligonucleotide

SEQ ID NO: 2313 - DNA, 51 bp, Artificial Sequence; identical to SEQ ID NO: 2205
  Description of Artificial Sequence: Synthetic oligonucleotide

SEQ ID NO: 2314 - DNA, 51 bp, Artificial Sequence; identical to SEQ ID NO: 2205
  Description of Artificial Sequence: Synthetic oligonucleotide

SEQ ID NO: 2315 - DNA, 51 bp, Artificial Sequence; identical to SEQ ID NO: 2205
  Description of Artificial Sequence: Synthetic oligonucleotide

SEQ ID NO: 2316 - DNA, 51 bp, Artificial Sequence; identical to SEQ ID NO: 2205
  Description of Artificial Sequence: Synthetic oligonucleotide

SEQ ID NO: 2317 - DNA, 51 bp, Artificial Sequence; identical to SEQ ID NO: 2205
  Description of Artificial Sequence: Synthetic oligonucleotide

SEQ ID NO: 2318 - DNA, 51 bp, Artificial Sequence; identical to SEQ ID NO: 2205
  Description of Artificial Sequence: Synthetic oligonucleotide

SEQ ID NO: 2319 - DNA, 51 bp, Artificial Sequence; identical to SEQ ID NO: 2205
  Description of Artificial Sequence: Synthetic oligonucleotide

SEQ ID NO: 2320 - DNA, 51 bp, Artificial Sequence; identical to SEQ ID NO: 2205
  Description of Artificial Sequence: Synthetic oligonucleotide

SEQ ID NO: 2321 - DNA, 51 bp, Artificial Sequence; identical to SEQ ID NO: 2205
  Description of Artificial Sequence: Synthetic oligonucleotide

SEQ ID NO: 2322 - DNA, 39 bp, Artificial Sequence
  Description of Artificial Sequence: Synthetic oligonucleotide
tctggaagtagctccaacatcggaagtcaaactgtaaac

SEQ ID NO: 2323 - DNA, 39 bp, Artificial Sequence; identical to SEQ ID NO: 2322
  Description of Artificial Sequence: Synthetic oligonucleotide

SEQ ID NO: 2324 - DNA, 39 bp, Artificial Sequence
  Description of Artificial Sequence: Synthetic oligonucleotide
tctggaagtagctccaacatcggaagtaattatgtaaac

SEQ ID NO: 2325 - DNA, 39 bp, Artificial Sequence; identical to SEQ ID NO: 2324
  Description of Artificial Sequence: Synthetic oligonucleotide

SEQ ID NO: 2326 - DNA, 39 bp, Artificial Sequence; identical to SEQ ID NO: 2322
  Description of Artificial Sequence: Synthetic oligonucleotide

SEQ ID NO: 2327 - DNA, 39 bp, Artificial Sequence; identical to SEQ ID NO: 2324
  Description of Artificial Sequence: Synthetic oligonucleotide

SEQ ID NO: 2328 - DNA, 39 bp, Artificial Sequence; identical to SEQ ID NO: 2199
  Description of Artificial Sequence: Synthetic oligonucleotide

SEQ ID NO: 2329 - DNA, 39 bp, Artificial Sequence; identical to SEQ ID NO: 2199
  Description of Artificial Sequence: Synthetic oligonucleotide

SEQ ID NO: 2330 - DNA, 39 bp, Artificial Sequence; identical to SEQ ID NO: 2199
  Description of Artificial Sequence: Synthetic oligonucleotide

SEQ ID NO: 2331 - DNA, 39 bp, Artificial Sequence; identical to SEQ ID NO: 2199
  Description of Artificial Sequence: Synthetic oligonucleotide

SEQ ID NO: 2332 - DNA, 39 bp, Artificial Sequence; identical to SEQ ID NO: 2199
  Description of Artificial Sequence: Synthetic oligonucleotide

SEQ ID NO: 2333 - DNA, 39 bp, Artificial Sequence; identical to SEQ ID NO: 2324
  Description of Artificial Sequence: Synthetic oligonucleotide

SEQ ID NO: 2334 - DNA, 39 bp, Artificial Sequence; identical to SEQ ID NO: 2324
  Description of Artificial Sequence: Synthetic oligonucleotide

SEQ ID NO: 2335 - DNA, 39 bp, Artificial Sequence; identical to SEQ ID NO: 2322
  Description of Artificial Sequence: Synthetic oligonucleotide

SEQ ID NO: 2336 - DNA, 33 bp, Artificial Sequence; identical to SEQ ID NO: 2226
  Description of Artificial Sequence: Synthetic oligonucleotide

SEQ ID NO: 2337 - DNA, 33 bp, Artificial Sequence; identical to SEQ ID NO: 2200
  Description of Artificial Sequence: Synthetic oligonucleotide

SEQ ID NO: 2338 - DNA, 39 bp, Artificial Sequence; identical to SEQ ID NO: 2199
  Description of Artificial Sequence: Synthetic oligonucleotide

SEQ ID NO: 2339 - DNA, 33 bp, Artificial Sequence
  Description of Artificial Sequence: Synthetic oligonucleotide
cgggcaagtcagaccattagcaggtttttaaat

SEQ ID NO: 2340 - DNA, 39 bp, Artificial Sequence
  Description of Artificial Sequence: Synthetic oligonucleotide
tctggaagcagctccaacattggaaataattatgtatcc

SEQ ID NO: 2341 - DNA, 33 bp, Artificial Sequence; identical to SEQ ID NO: 2339
  Description of Artificial Sequence: Synthetic oligonucleotide

SEQ ID NO: 2342 - DNA, 33 bp, Artificial Sequence; identical to SEQ ID NO: 2339
  Description of Artificial Sequence: Synthetic oligonucleotide

SEQ ID NO: 2343 - DNA, 33 bp, Artificial Sequence; identical to SEQ ID NO: 2339
  Description of Artificial Sequence: Synthetic oligonucleotide

SEQ ID NO: 2344 - DNA, 33 bp, Artificial Sequence; identical to SEQ ID NO: 2339
  Description of Artificial Sequence: Synthetic oligonucleotide

SEQ ID NO: 2345 - DNA, 33 bp, Artificial Sequence; identical to SEQ ID NO: 2339
  Description of Artificial Sequence: Synthetic oligonucleotide

SEQ ID NO: 2346 - DNA, 33 bp, Artificial Sequence; identical to SEQ ID NO: 2339
  Description of Artificial Sequence: Synthetic oligonucleotide

SEQ ID NO: 2347 - DNA, 39 bp, Artificial Sequence; identical to SEQ ID NO: 2340
  Description of Artificial Sequence: Synthetic oligonucleotide

SEQ ID NO: 2348 - DNA, 39 bp, Artificial Sequence; identical to SEQ ID NO: 2340
  Description of Artificial Sequence: Synthetic oligonucleotide

SEQ ID NO: 2349 - DNA, 39 bp, Artificial Sequence; identical to SEQ ID NO: 2340
  Description of Artificial Sequence: Synthetic oligonucleotide

SEQ ID NO: 2350 - DNA, 39 bp, Artificial Sequence; identical to SEQ ID NO: 2340
  Description of Artificial Sequence: Synthetic oligonucleotide

SEQ ID NO: 2351 - DNA, 39 bp, Artificial Sequence; identical to SEQ ID NO: 2340
  Description of Artificial Sequence: Synthetic oligonucleotide

SEQ ID NO: 2352 - DNA, 39 bp, Artificial Sequence; identical to SEQ ID NO: 2340
  Description of Artificial Sequence: Synthetic oligonucleotide

SEQ ID NO: 2353 - DNA, 39 bp, Artificial Sequence; identical to SEQ ID NO: 2340
  Description of Artificial Sequence: Synthetic oligonucleotide

SEQ ID NO: 2354 - DNA, 39 bp, Artificial Sequence; identical to SEQ ID NO: 2340
  Description of Artificial Sequence: Synthetic oligonucleotide

SEQ ID NO: 2355 - DNA, 33 bp, Artificial Sequence; identical to SEQ ID NO: 2339
  Description of Artificial Sequence: Synthetic oligonucleotide

SEQ ID NO: 2356 - DNA, 21 bp, Artificial Sequence
  Description of Artificial Sequence: Synthetic oligonucleotide
actaataatcagcggccctca

SEQ ID NO: 2357 - DNA, 21 bp, Artificial Sequence
  Description of Artificial Sequence: Synthetic oligonucleotide
ggtgcatccagtttgcaaagt

SEQ ID NO: 2358 - DNA, 21 bp, Artificial Sequence
  Description of Artificial Sequence: Synthetic oligonucleotide
ggtgcatccagtttgcaaagt

SEQ ID NO: 2359 - DNA, 21 bp, Artificial Sequence
  Description of Artificial Sequence: Synthetic oligonucleotide
gatgcatccaatttggaaaca

SEQ ID NO: 2360 - DNA, 21 bp, Artificial Sequence
  Description of Artificial Sequence: Synthetic oligonucleotide
tgggcatctacccgggaatcc

SEQ ID NO: 2361 - DNA, 21 bp, Artificial Sequence
  Description of Artificial Sequence: Synthetic oligonucleotide
tgggcatctacccgggaatcc

SEQ ID NO: 2362 - DNA, 21 bp, Artificial Sequence
  Description of Artificial Sequence: Synthetic oligonucleotide
tggacttctacccgagattcc

SEQ ID NO: 2363 - DNA, 21 bp, Artificial Sequence
  Description of Artificial Sequence: Synthetic oligonucleotide
tggacttctacccgagattcc

SEQ ID NO: 2364 - DNA, 21 bp, Artificial Sequence
  Description of Artificial Sequence: Synthetic oligonucleotide
ggtgcatccagcagggccact

SEQ ID NO: 2365 - DNA, 21 bp, Artificial Sequence
  Description of Artificial Sequence: Synthetic oligonucleotide
ggtgcagccaccagggccact

SEQ ID NO: 2366 - DNA, 21 bp, Artificial Sequence
  Description of Artificial Sequence: Synthetic oligonucleotide
ggtgcatccagtttgcaaagt

SEQ ID NO: 2367 - DNA, 21 bp, Artificial Sequence
  Description of Artificial Sequence: Synthetic oligonucleotide
gatgcttccaatttggagcca

SEQ ID NO: 2368 - DNA, 21 bp, Artificial Sequence
  Description of Artificial Sequence: Synthetic oligonucleotide
gctgcatccagtttgcaaagt

SEQ ID NO: 2369 - DNA, 21 bp, Artificial Sequence
  Description of Artificial Sequence: Synthetic oligonucleotide
gctgcatccagtttgcaaagt

SEQ ID NO: 2370 - DNA, 21 bp, Artificial Sequence
  Description of Artificial Sequence: Synthetic oligonucleotide
ggtgcatccagtttgcaaagt

SEQ ID NO: 2371 - DNA, 21 bp, Artificial Sequence
  Description of Artificial Sequence: Synthetic oligonucleotide
ggtgcatccagtttgcaaagt

SEQ ID NO: 2372 - DNA, 21 bp, Artificial Sequence
  Description of Artificial Sequence: Synthetic oligonucleotide
ggtgcatccagtttgcaaagt

SEQ ID NO: 2373 - DNA, 21 bp, Artificial Sequence
  Description of Artificial Sequence: Synthetic oligonucleotide
ggtgcatccagtttgcaaagt

SEQ ID NO: 2374 - DNA, 21 bp, Artificial Sequence
  Description of Artificial Sequence: Synthetic oligonucleotide
ggtgcatccagtttgcaaagt

SEQ ID NO: 2375 - DNA, 21 bp, Artificial Sequence
  Description of Artificial Sequence: Synthetic oligonucleotide
ggtgcatccagtttgcaaagt

SEQ ID NO: 2376 - DNA, 21 bp, Artificial Sequence
  Description of Artificial Sequence: Synthetic oligonucleotide
ggtgcatccagtttgcaaagt

SEQ ID NO: 2377 - DNA, 21 bp, Artificial Sequence
  Description of Artificial Sequence: Synthetic oligonucleotide
ggtgcatccagtttgcaaagt

SEQ ID NO: 2378 - DNA, 21 bp, Artificial Sequence
  Description of Artificial Sequence: Synthetic oligonucleotide
ggtgcatccagtttgcaaagt

SEQ ID NO: 2379 - DNA, 21 bp, Artificial Sequence
  Description of Artificial Sequence: Synthetic oligonucleotide
ggtgcatccagtttgcaaagt

SEQ ID NO: 2380 - DNA, 21 bp, Artificial Sequence
  Description of Artificial Sequence: Synthetic oligonucleotide
ggtgcatccagtttgcaaagt

SEQ ID NO: 2381 - DNA, 21 bp, Artificial Sequence
  Description of Artificial Sequence: Synthetic oligonucleotide
ggtgcatccagtttgcaaagt

SEQ ID NO: 2382 - DNA, 21 bp, Artificial Sequence
  Description of Artificial Sequence: Synthetic oligonucleotide
ggtgcatccagtttgcaaagt

SEQ ID NO: 2383 - DNA, 21 bp, Artificial Sequence
  Description of Artificial Sequence: Synthetic oligonucleotide
ggtgcatccagtttgcaaagt

SEQ ID NO: 2384 - DNA, 21 bp, Artificial Sequence
  Description of Artificial Sequence: Synthetic oligonucleotide
ggtgcatccagtttgcaaagt

SEQ ID NO: 2385 - DNA, 21 bp, Artificial Sequence
  Description of Artificial Sequence: Synthetic oligonucleotide
ggtgcatccagtttgcaaagt

SEQ ID NO: 2386 - DNA, 21 bp, Artificial Sequence
  Description of Artificial Sequence: Synthetic oligonucleotide
ggtgcatccagtttgcaaagt

SEQ ID NO: 2387 - DNA, 21 bp, Artificial Sequence
  Description of Artificial Sequence: Synthetic oligonucleotide
ggtgcatccagtttgcaaagt

SEQ ID NO: 2388 - DNA, 21 bp, Artificial Sequence
  Description of Artificial Sequence: Synthetic oligonucleotide
ggtgcatccagtttgcaaagt

SEQ ID NO: 2389 - DNA, 21 bp, Artificial Sequence
  Description of Artificial Sequence: Synthetic oligonucleotide
ggtgcatccagtttgcaaagt

SEQ ID NO: 2390 - DNA, 21 bp, Artificial Sequence
  Description of Artificial Sequence: Synthetic oligonucleotide
ggtgcatccagtttgcaaagt

SEQ ID NO: 2391 - DNA, 21 bp, Artificial Sequence
  Description of Artificial Sequence: Synthetic oligonucleotide
ggtgcatccagtttgcaaagt

SEQ ID NO: 2392 - DNA, 21 bp, Artificial Sequence
  Description of Artificial Sequence: Synthetic oligonucleotide
ggtgcatccagtttgcaaagt

SEQ ID NO: 2393 - DNA, 21 bp, Artificial Sequence
  Description of Artificial Sequence: Synthetic oligonucleotide
ggtgcatccagtttgcaaagt

SEQ ID NO: 2394 - DNA, 21 bp, Artificial Sequence
  Description of Artificial Sequence: Synthetic oligonucleotide
ggtgcatccagtttgcaaagt

SEQ ID NO: 2395 - DNA, 21 bp, Artificial Sequence
  Description of Artificial Sequence: Synthetic oligonucleotide
gatgcatccaatttggaaaca

SEQ ID NO: 2396 - DNA, 21 bp, Artificial Sequence
  Description of Artificial Sequence: Synthetic oligonucleotide
gatgcatccaatttggaaaca

SEQ ID NO: 2397 - DNA, 21 bp, Artificial Sequence
  Description of Artificial Sequence: Synthetic oligonucleotide
gatgcatccaatttggaaaca

SEQ ID NO: 2398 - DNA, 21 bp, Artificial Sequence
  Description of Artificial Sequence: Synthetic oligonucleotide
gatgcatccaatttggaaaca

SEQ ID NO: 2399 - DNA, 21 bp, Artificial Sequence
  Description of Artificial Sequence: Synthetic oligonucleotide
gatgcatccaatttggaaaca

SEQ ID NO: 2400 - DNA, 21 bp, Artificial Sequence
  Description of Artificial Sequence: Synthetic oligonucleotide
gatgcatccaatttggaaaca

SEQ ID NO: 2401 - DNA, 21 bp, Artificial Sequence
  Description of Artificial Sequence: Synthetic oligonucleotide
gatgcatccaatttggaaaca

SEQ ID NO: 2402 - DNA, 21 bp, Artificial Sequence
  Description of Artificial Sequence: Synthetic oligonucleotide
gatgcatccaatttggaaaca

SEQ ID NO: 2403 - DNA, 21 bp, Artificial Sequence
  Description of Artificial Sequence: Synthetic oligonucleotide
gatgcatccaatttggaaaca

SEQ ID NO: 2404 - DNA, 21 bp, Artificial Sequence
  Description of Artificial Sequence: Synthetic oligonucleotide
ggtgcatccagtttgcaaagt

SEQ ID NO: 2405 - DNA, 21 bp, Artificial Sequence
  Description of Artificial Sequence: Synthetic oligonucleotide
ggtgcatccagtttgcaaagt

SEQ ID NO: 2406 - DNA, 21 bp, Artificial Sequence
  Description of Artificial Sequence: Synthetic oligonucleotide
ggtgcatccagtttgcaaagt

SEQ ID NO: 2407 - DNA, 21 bp, Artificial Sequence
  Description of Artificial Sequence: Synthetic oligonucleotide
ggtgcatccagtttgcaaagt

SEQ ID NO: 2408 - DNA, 21 bp, Artificial Sequence
  Description of Artificial Sequence: Synthetic oligonucleotide
ggtgcatccagtttgcaaagt

SEQ ID NO: 2409 - DNA, 21 bp, Artificial Sequence
  Description of Artificial Sequence: Synthetic oligonucleotide
ggtgcatccagtttgcaaagt

SEQ ID NO: 2410 - DNA, 21 bp, Artificial Sequence
  Description of Artificial Sequence: Synthetic oligonucleotide
ggtgcatccagtttgcaaagt

SEQ ID NO: 2411 - DNA, 21 bp, Artificial Sequence
  Description of Artificial Sequence: Synthetic oligonucleotide
gatgcttccaatttggagcca

SEQ ID NO: 2412 - DNA, 21 bp, Artificial Sequence
  Description of Artificial Sequence: Synthetic oligonucleotide
gatgcttccaatttggagcca

SEQ ID NO: 2413 - DNA, 21 bp, Artificial Sequence
  Description of Artificial Sequence: Synthetic oligonucleotide
gatgcttccaatttggagcca

SEQ ID NO: 2414 - DNA, 21 bp, Artificial Sequence
  Description of Artificial Sequence: Synthetic oligonucleotide
gatgcttccaatttggagcca

SEQ ID NO: 2415 - DNA, 21 bp, Artificial Sequence
  Description of Artificial Sequence: Synthetic oligonucleotide
gatgcttccaatttggagcca

SEQ ID NO: 2416 - DNA, 21 bp, Artificial Sequence
  Description of Artificial Sequence: Synthetic oligonucleotide
gatgcttccaatttggagcca

SEQ ID NO: 2417 - DNA, 21 bp, Artificial Sequence
  Description of Artificial Sequence: Synthetic oligonucleotide
gatgcttccaatttggagcca

SEQ ID NO: 2418 - DNA, 21 bp, Artificial Sequence
  Description of Artificial Sequence: Synthetic oligonucleotide
gatgcttccaatttggagcca

SEQ ID NO: 2419 - DNA, 21 bp, Artificial Sequence
  Description of Artificial Sequence: Synthetic oligonucleotide
gatgcttccaatttggagcca

SEQ ID NO: 2420 - DNA, 21 bp, Artificial Sequence
  Description of Artificial Sequence: Synthetic oligonucleotide
gatgcttccaatttggagcca

SEQ ID NO: 2421 - DNA, 21 bp, Artificial Sequence
  Description of Artificial Sequence: Synthetic oligonucleotide
gatgcttccaatttggagcca

SEQ ID NO: 2422 - DNA, 21 bp, Artificial Sequence
  Description of Artificial Sequence: Synthetic oligonucleotide
ggtgcatccagcagggccact

SEQ ID NO: 2423 - DNA, 21 bp, Artificial Sequence
  Description of Artificial Sequence: Synthetic oligonucleotide
ggtgcatccagcagggccact

SEQ ID NO: 2424 - DNA, 21 bp, Artificial Sequence
  Description of Artificial Sequence: Synthetic oligonucleotide
ggtgcatccagcagggccact

SEQ ID NO: 2425 - DNA, 21 bp, Artificial Sequence
  Description of Artificial Sequence: Synthetic oligonucleotide
ggtgcatccagcagggccact

SEQ ID NO: 2426 - DNA, 21 bp, Artificial Sequence
  Description of Artificial Sequence: Synthetic oligonucleotide
ggtgcagccaccagggccact

SEQ ID NO: 2427 - DNA, 21 bp, Artificial Sequence
  Description of Artificial Sequence: Synthetic oligonucleotide
ggtgcagccaccagggccact

SEQ ID NO: 2428 - DNA, 21 bp, Artificial Sequence
  Description of Artificial Sequence: Synthetic oligonucleotide
ggtgcagccaccagggccact

SEQ ID NO: 2429 - DNA, 21 bp, Artificial Sequence
  Description of Artificial Sequence: Synthetic oligonucleotide
ggtgcagccaccagggccact

SEQ ID NO: 2430 - DNA, 21 bp, Artificial Sequence
  Description of Artificial Sequence: Synthetic oligonucleotide
ggtgcagccaccagggccact

SEQ ID NO: 2431 - DNA, 21 bp, Artificial Sequence
  Description of Artificial Sequence: Synthetic oligonucleotide
ggtgcagccaccagggccact

SEQ ID NO: 2432 - DNA, 21 bp, Artificial Sequence
  Description of Artificial Sequence: Synthetic oligonucleotide
ggtgcagccaccagggccact

SEQ ID NO: 2433 - DNA, 21 bp, Artificial Sequence
  Description of Artificial Sequence: Synthetic oligonucleotide
ggtgcagccaccagggccact

SEQ ID NO: 2434 - DNA, 21 bp, Artificial Sequence
  Description of Artificial Sequence: Synthetic oligonucleotide
ggtgcatccagcagggccact

SEQ ID NO: 2435 - DNA, 21 bp, Artificial Sequence
  Description of Artificial Sequence: Synthetic oligonucleotide
ggtgcatccagcagggccact

SEQ ID NO: 2436 - DNA, 21 bp, Artificial Sequence
  Description of Artificial Sequence: Synthetic oligonucleotide
ggtgcatccagcagggccact

SEQ ID NO: 2437 - DNA, 21 bp, Artificial Sequence
  Description of Artificial Sequence: Synthetic oligonucleotide
ggtgcatccagcagggccact

SEQ ID NO: 2438 - DNA, 21 bp, Artificial Sequence
  Description of Artificial Sequence: Synthetic oligonucleotide
ggtgcatccagcagggccact

SEQ ID NO: 2439 - DNA, 21 bp, Artificial Sequence
  Description of Artificial Sequence: Synthetic oligonucleotide
ggtgcatccagcagggccact

SEQ ID NO: 2440 - DNA, 21 bp, Artificial Sequence
  Description of Artificial Sequence: Synthetic oligonucleotide
ggtgcatccagcagggccact

SEQ ID NO: 2441 - DNA, 21 bp, Artificial Sequence
  Description of Artificial Sequence: Synthetic oligonucleotide
tgggcatctacccgggaatcc

SEQ ID NO: 2442 - DNA, 21 bp, Artificial Sequence
  Description of Artificial Sequence: Synthetic oligonucleotide
tgggcatctacccgggaatcc

SEQ ID NO: 2443 - DNA, 21 bp, Artificial Sequence
  Description of Artificial Sequence: Synthetic oligonucleotide
tgggcatctacccgggaatcc

SEQ ID NO: 2444 - DNA, 21 bp, Artificial Sequence
  Description of Artificial Sequence: Synthetic oligonucleotide
tgggcatctacccgggaatcc

SEQ ID NO: 2445 - DNA, 21 bp, Artificial Sequence
  Description of Artificial Sequence: Synthetic oligonucleotide
tgggcatctacccgggaatcc

SEQ ID NO: 2446 - DNA, 21 bp, Artificial Sequence
  Description of Artificial Sequence: Synthetic oligonucleotide
tgggcatctacccgggaatcc

SEQ ID NO: 2447 - DNA, 21 bp, Artificial Sequence
  Description of Artificial Sequence: Synthetic oligonucleotide
tgggcatctacccgggaatcc

SEQ ID NO: 2448 - DNA, 21 bp, Artificial Sequence
  Description of Artificial Sequence: Synthetic oligonucleotide
tgggcatctacccgggaatcc

SEQ ID NO: 2449 - DNA, 21 bp, Artificial Sequence
  Description of Artificial Sequence: Synthetic oligonucleotide
tgggcatctacccgggaatcc

SEQ ID NO: 2450 - DNA, 21 bp, Artificial Sequence
  Description of Artificial Sequence: Synthetic oligonucleotide
tgggcatctacccgggaatcc

SEQ ID NO: 2451 - DNA, 21 bp, Artificial Sequence
  Description of Artificial Sequence: Synthetic oligonucleotide
tgggcatctacccgggaatcc

SEQ ID NO: 2452 - DNA, 21 bp, Artificial Sequence
  Description of Artificial Sequence: Synthetic oligonucleotide
tggacttctacccgagaatcc

SEQ ID NO: 2453 - DNA, 21 bp, Artificial Sequence
  Description of Artificial Sequence: Synthetic oligonucleotide
tggacttctacccgagaatcc

SEQ ID NO: 2454 - DNA, 21 bp, Artificial Sequence
  Description of Artificial Sequence: Synthetic oligonucleotide
tggacttctacccgagattcc

SEQ ID NO: 2455 - DNA, 21 bp, Artificial Sequence
  Description of Artificial Sequence: Synthetic oligonucleotide
tggacttctacccgagaatcc

SEQ ID NO: 2456 - DNA, 21 bp, Artificial Sequence
  Description of Artificial Sequence: Synthetic oligonucleotide
tggacttctacccgagaatcc

SEQ ID NO: 2457 - DNA, 21 bp, Artificial Sequence
  Description of Artificial Sequence: Synthetic oligonucleotide
tggacttctacccgagattcc

SEQ ID NO: 2458 - DNA, 21 bp, Artificial Sequence
  Description of Artificial Sequence: Synthetic oligonucleotide
tggacttctacccgagattcc

SEQ ID NO: 2459 - DNA, 21 bp, Artificial Sequence
  Description of Artificial Sequence: Synthetic oligonucleotide
tggacttctacccgagaatcc

SEQ ID NO: 2460 - DNA, 21 bp, Artificial Sequence
  Description of Artificial Sequence: Synthetic oligonucleotide
tggacttctacccgagaatcc

SEQ ID NO: 2461 - DNA, 21 bp, Artificial Sequence
  Description of Artificial Sequence: Synthetic oligonucleotide
tgggcatctacccgggaatcc

SEQ ID NO: 2462 - DNA, 21 bp, Artificial Sequence
  Description of Artificial Sequence: Synthetic oligonucleotide
tgggcatctacccgggaatcc

SEQ ID NO: 2463 - DNA, 21 bp, Artificial Sequence
  Description of Artificial Sequence: Synthetic oligonucleotide
tgggcatctacccgggaatcc

SEQ ID NO: 2464 - DNA, 21 bp, Artificial Sequence
  Description of Artificial Sequence: Synthetic oligonucleotide
tgggcatctacccgggaatcc

SEQ ID NO: 2465 - DNA, 21 bp, Artificial Sequence
  Description of Artificial Sequence: Synthetic oligonucleotide
tgggcatctacccgggaatcc

SEQ ID NO: 2466 - DNA, 21 bp, Artificial Sequence
  Description of Artificial Sequence: Synthetic oligonucleotide
tggacttctacccgagattcc

SEQ ID NO: 2467 - DNA, 21 bp, Artificial Sequence
  Description of Artificial Sequence: Synthetic oligonucleotide
tggacttctacccgagattcc

SEQ ID NO: 2468 - DNA, 21 bp, Artificial Sequence
  Description of Artificial Sequence: Synthetic oligonucleotide
tggacttctacccgagattcc

SEQ ID NO: 2469 - DNA, 21 bp, Artificial Sequence
  Description of Artificial Sequence: Synthetic oligonucleotide
tggacttctacccgagattcc

SEQ ID NO: 2470 - DNA, 21 bp, Artificial Sequence
  Description of Artificial Sequence: Synthetic oligonucleotide
tggacttctacccgagattcc

SEQ ID NO: 2471 - DNA, 21 bp, Artificial Sequence
  Description of Artificial Sequence: Synthetic oligonucleotide
tggacttctacccgagattcc

SEQ ID NO: 2472 - DNA, 21 bp, Artificial Sequence
  Description of Artificial Sequence: Synthetic oligonucleotide
tggacttctacccgagattcc

SEQ ID NO: 2473 - DNA, 21 bp, Artificial Sequence
  Description of Artificial Sequence: Synthetic oligonucleotide
tggacttctacccgagaatcc

SEQ ID NO: 2474 - DNA, 21 bp, Artificial Sequence
  Description of Artificial Sequence: Synthetic oligonucleotide
tggacttctacccgagaatcc

SEQ ID NO: 2475 - DNA, 21 bp, Artificial Sequence
  Description of Artificial Sequence: Synthetic oligonucleotide
tggacttctacccgagaatcc

SEQ ID NO: 2476 - DNA, 21 bp, Artificial Sequence
  Description of Artificial Sequence: Synthetic oligonucleotide
tggacttctacccgagaatcc

SEQ ID NO: 2477 - DNA, 21 bp, Artificial Sequence
  Description of Artificial Sequence: Synthetic oligonucleotide
tggacttctacccgagattcc

SEQ ID NO: 2478 - DNA, 21 bp, Artificial Sequence
  Description of Artificial Sequence: Synthetic oligonucleotide
tggacttctacccgagaatcc

SEQ ID NO: 2479 - DNA, 21 bp, Artificial Sequence
  Description of Artificial Sequence: Synthetic oligonucleotide
actaataatcagcggccctca

SEQ ID NO: 2480 - DNA, 21 bp, Artificial Sequence
  Description of Artificial Sequence: Synthetic oligonucleotide
actaataatcagcggccctca

SEQ ID NO: 2481 - DNA, 21 bp, Artificial Sequence
  Description of Artificial Sequence: Synthetic oligonucleotide
actaataatcagcggccctca

SEQ ID NO: 2482 - DNA, 21 bp, Artificial Sequence
  Description of Artificial Sequence: Synthetic oligonucleotide
actaataatcagcggccctca

SEQ ID NO: 2483 - DNA, 21 bp, Artificial Sequence
  Description of Artificial Sequence: Synthetic oligonucleotide
actaataatcagcggccctca

SEQ ID NO: 2484 - DNA, 21 bp, Artificial Sequence
  Description of Artificial Sequence: Synthetic oligonucleotide
actaataatcagcggccctca

SEQ ID NO: 2485 - DNA, 21 bp, Artificial Sequence
  Description of Artificial Sequence: Synthetic oligonucleotide
actaataatcagcggccctca

SEQ ID NO: 2486 - DNA, 21 bp, Artificial Sequence
  Description of Artificial Sequence: Synthetic oligonucleotide
actaataatcagcggccctca

SEQ ID NO: 2487 - DNA, 21 bp, Artificial Sequence
  Description of Artificial Sequence: Synthetic oligonucleotide
actaataatcagcggccctca

SEQ ID NO: 2488 - DNA, 21 bp, Artificial Sequence
  Description of Artificial Sequence: Synthetic oligonucleotide
actaataatcagcggccctca

SEQ ID NO: 2489 - DNA, 21 bp, Artificial Sequence
  Description of Artificial Sequence: Synthetic oligonucleotide
actaataatcagcggccctca

SEQ ID NO: 2490 - DNA, 21 bp, Artificial Sequence
  Description of Artificial Sequence: Synthetic oligonucleotide
actaataatcagcggccctca

SEQ ID NO: 2491 - DNA, 21 bp, Artificial Sequence
  Description of Artificial Sequence: Synthetic oligonucleotide
actaataatcagcggccctca

SEQ ID NO: 2492 - DNA, 21 bp, Artificial Sequence
  Description of Artificial Sequence: Synthetic oligonucleotide
actaataatcagcggccctca

SEQ ID NO: 2493 - DNA, 21 bp, Artificial Sequence
  Description of Artificial Sequence: Synthetic oligonucleotide
ggtgcatccagtttgcaaagt

SEQ ID NO: 2494 - DNA, 21 bp, Artificial Sequence
  Description of Artificial Sequence: Synthetic oligonucleotide
ggtgcatccagtttgcaaagt

SEQ ID NO: 2495 - DNA, 21 bp, Artificial Sequence
  Description of Artificial Sequence: Synthetic oligonucleotide
actaataatcagcggccctca

SEQ ID NO: 2496 - DNA, 21 bp, Artificial Sequence
  Description of Artificial Sequence: Synthetic oligonucleotide
gttgcatccagtttgcaaagt

SEQ ID NO: 2497 - DNA, 21 bp, Artificial Sequence
  Description of Artificial Sequence: Synthetic oligonucleotide
gacaataataagcgaccctca

SEQ ID NO: 2498 - DNA, 21 bp, Artificial Sequence
  Description of Artificial Sequence: Synthetic oligonucleotide
gttgcatccagtttgcaaagt

SEQ ID NO: 2499 - DNA, 21 bp, Artificial Sequence
  Description of Artificial Sequence: Synthetic oligonucleotide
gttgcatccagtttgcaaagt

SEQ ID NO: 2500 - DNA, 21 bp, Artificial Sequence
  Description of Artificial Sequence: Synthetic oligonucleotide
gttgcatccagtttgcaaagt

SEQ ID NO: 2501 - DNA, 21 bp, Artificial Sequence
  Description of Artificial Sequence: Synthetic oligonucleotide
gttgcatccagtttgcaaagt

SEQ ID NO: 2502 - DNA, 21 bp, Artificial Sequence
  Description of Artificial Sequence: Synthetic oligonucleotide
gttgcatccagtttgcaaagt

SEQ ID NO: 2503 - DNA, 21 bp, Artificial Sequence
  Description of Artificial Sequence: Synthetic oligonucleotide
gttgcatccagtttgcaaagt

SEQ ID NO: 2504 - DNA, 21 bp, Artificial Sequence
  Description of Artificial Sequence: Synthetic oligonucleotide
gacaataataagcgaccctca

SEQ ID NO: 2505 - DNA, 21 bp, Artificial Sequence
  Description of Artificial Sequence: Synthetic oligonucleotide
gacaataataagcgaccctca

SEQ ID NO: 2506 - DNA, 21 bp, Artificial Sequence
  Description of Artificial Sequence: Synthetic oligonucleotide
gacaataataagcgaccctca

SEQ ID NO: 2507 - DNA, 21 bp, Artificial Sequence
  Description of Artificial Sequence: Synthetic oligonucleotide
gacaataataagcgaccctca

SEQ ID NO: 2508 - DNA, 21 bp, Artificial Sequence
  Description of Artificial Sequence: Synthetic oligonucleotide
gacaataataagcgaccctca

SEQ ID NO: 2509 - DNA, 21 bp, Artificial Sequence
  Description of Artificial Sequence: Synthetic oligonucleotide
gacaataataagcgaccctca

SEQ ID NO: 2510 - DNA, 21 bp, Artificial Sequence
  Description of Artificial Sequence: Synthetic oligonucleotide
gacaataataagcgaccctca

SEQ ID NO: 2511 - DNA, 21 bp, Artificial Sequence
  Description of Artificial Sequence: Synthetic oligonucleotide
gacaataataagcgaccctca

SEQ ID NO: 2512 - DNA, 21 bp, Artificial Sequence
  Description of Artificial Sequence: Synthetic oligonucleotide
gttgcatccagtttgcaaagt

SEQ ID NO: 2513 - DNA, 33 bp, Artificial Sequence
  Description of Artificial Sequence: Synthetic oligonucleotide
gcaacattcgatgacagcctgaatggtccggta

SEQ ID NO: 2514 - DNA, 27 bp, Artificial Sequence
  Description of Artificial Sequence: Synthetic oligonucleotide
ctacagcataataattaccccttcact

SEQ ID NO: 2515 - DNA, 27 bp, Artificial Sequence
  Description of Artificial Sequence: Synthetic oligonucleotide
ctacagcataataattaccccttcact

SEQ ID NO: 2516 - DNA, 24 bp, Artificial Sequence
  Description of Artificial Sequence: Synthetic oligonucleotide
caacagtatgatattctcctcact

SEQ ID NO: 2517 - DNA, 27 bp, Artificial Sequence
  Description of Artificial Sequence: Synthetic oligonucleotide
caacaatattatagtactccgtggacg

SEQ ID NO: 2518 - DNA, 27 bp, Artificial Sequence
  Description of Artificial Sequence: Synthetic oligonucleotide
caacaatattatagtactccgtggacg

SEQ ID NO: 2519 - DNA, 27 bp, Artificial Sequence
  Description of Artificial Sequence: Synthetic oligonucleotide
cagcaatattatcgtactccgtggacg

SEQ ID NO: 2520 - DNA, 27 bp, Artificial Sequence
  Description of Artificial Sequence: Synthetic oligonucleotide
cagcaatattatcgtactccgtggacg

SEQ ID NO: 2521 - DNA, 27 bp, Artificial Sequence
  Description of Artificial Sequence: Synthetic oligonucleotide
cagcagtatggtagttcaccgctcact

SEQ ID NO: 2522 - DNA, 27 bp, Artificial Sequence
  Description of Artificial Sequence: Synthetic oligonucleotide
cagcagtataataactggcctctcact

SEQ ID NO: 2523 - DNA, 27 bp, Artificial Sequence
  Description of Artificial Sequence: Synthetic oligonucleotide
ctacagcataatagttacccattcact

SEQ ID NO: 2524 - DNA, 24 bp, Artificial Sequence
  Description of Artificial Sequence: Synthetic oligonucleotide
caacagtatgatgatctattcact

SEQ ID NO: 2525 - DNA, 27 bp, Artificial Sequence
  Description of Artificial Sequence: Synthetic oligonucleotide
caacagactaacagtttccctccgacg

SEQ ID NO: 2526 - DNA, 27 bp, Artificial Sequence
  Description of Artificial Sequence: Synthetic oligonucleotide
caacagactaacagtttccctccgacg

SEQ ID NO: 2527 - DNA, 27 bp, Artificial Sequence
  Description of Artificial Sequence: Synthetic oligonucleotide
ctacagcataatagttacccattcact

SEQ ID NO: 2528 - DNA, 27 bp, Artificial Sequence
  Description of Artificial Sequence: Synthetic oligonucleotide
ctacagcataatagttacccattcact

SEQ ID NO: 2529 - DNA, 27 bp, Artificial Sequence
  Description of Artificial Sequence: Synthetic oligonucleotide
ctacagcataatagttacccattcact

SEQ ID NO: 2530 - DNA, 27 bp, Artificial Sequence
  Description of Artificial Sequence: Synthetic oligonucleotide
ctacagcataatagttacccattcact

SEQ ID NO: 2531 - DNA, 27 bp, Artificial Sequence
  Description of Artificial Sequence: Synthetic oligonucleotide
ctacagcataatagttacccattcact

SEQ ID NO: 2532 - DNA, 27 bp, Artificial Sequence
  Description of Artificial Sequence: Synthetic oligonucleotide
ctacagcataatagttacccattcact

SEQ ID NO: 2533 - DNA, 27 bp, Artificial Sequence
  Description of Artificial Sequence: Synthetic oligonucleotide
ctacagcataataattaccccttcact

SEQ ID NO: 2534 - DNA, 27 bp, Artificial Sequence
  Description of Artificial Sequence: Synthetic oligonucleotide
ctacagcataataattaccccttcact

SEQ ID NO: 2535 - DNA, 27 bp, Artificial Sequence
  Description of Artificial Sequence: Synthetic oligonucleotide
ctacagcataataattaccccttcact

SEQ ID NO: 2536 - DNA, 27 bp, Artificial Sequence
  Description of Artificial Sequence: Synthetic oligonucleotide
ctacagcataataattaccccttcact

SEQ ID NO: 2537 - DNA, 27 bp, Artificial Sequence
  Description of Artificial Sequence: Synthetic oligonucleotide
ctacagcataataattaccccttcact

SEQ ID NO: 2538 - DNA, 27 bp, Artificial Sequence
  Description of Artificial Sequence: Synthetic oligonucleotide
ctacagcataataattaccccttcact

SEQ ID NO: 2539 - DNA, 27 bp, Artificial Sequence
  Description of Artificial Sequence: Synthetic oligonucleotide
ctacagcataataattaccccttcact

SEQ ID NO: 2540 - DNA, 27 bp, Artificial Sequence
  Description of Artificial Sequence: Synthetic oligonucleotide
ctacagcataataattaccccttcact

SEQ ID NO: 2541 - DNA, 27 bp, Artificial Sequence
  Description of Artificial Sequence: Synthetic oligonucleotide
ctacagcataataattaccccttcact

SEQ ID NO: 2542 - DNA, 27 bp, Artificial Sequence
  Description of Artificial Sequence: Synthetic oligonucleotide
ctacagcataataattaccccttcact

SEQ ID NO: 2543 - DNA, 27 bp, Artificial Sequence
  Description of Artificial Sequence: Synthetic oligonucleotide
ctacagcataataattaccccttcact

SEQ ID NO: 2544 - DNA, 27 bp, Artificial Sequence
  Description of Artificial Sequence: Synthetic oligonucleotide
ctacagcataataattaccccttcact

SEQ ID NO: 2545 - DNA, 27 bp, Artificial Sequence
  Description of Artificial Sequence: Synthetic oligonucleotide
ctacagcataataattaccccttcact

SEQ ID NO: 2546 - DNA, 27 bp, Artificial Sequence
  Description of Artificial Sequence: Synthetic oligonucleotide
ctacagcataataattaccccttcact

SEQ ID NO: 2547 - DNA, 27 bp, Artificial Sequence
  Description of Artificial Sequence: Synthetic oligonucleotide
ctacagcataataattaccccttcact

SEQ ID NO: 2548 - DNA, 27 bp, Artificial Sequence
  Description of Artificial Sequence: Synthetic oligonucleotide
ctacagcataataattaccccttcact

SEQ ID NO: 2549 - DNA, 27 bp, Artificial Sequence
  Description of Artificial Sequence: Synthetic oligonucleotide
ctacagcataataattaccccttcact

SEQ ID NO: 2550 - DNA, 27 bp, Artificial Sequence
  Description of Artificial Sequence: Synthetic oligonucleotide
ctacagcataataattaccccttcact

SEQ ID NO: 2551 - DNA, 27 bp, Artificial Sequence
  Description of Artificial Sequence: Synthetic oligonucleotide
ctacagcataataattaccccttcact

SEQ ID NO: 2552 - DNA, 24 bp, Artificial Sequence
  Description of Artificial Sequence: Synthetic oligonucleotide
caacagtatgatattctcctcact

SEQ ID NO: 2553 - DNA, 24 bp, Artificial Sequence
  Description of Artificial Sequence: Synthetic oligonucleotide
caacagtatgatattctcctcact

SEQ ID NO: 2554 - DNA, 24 bp, Artificial Sequence
  Description of Artificial Sequence: Synthetic oligonucleotide
caacagtatgatattctcctcact

SEQ ID NO: 2555 - DNA, 24 bp, Artificial Sequence
  Description of Artificial Sequence: Synthetic oligonucleotide
caacagtatgatattctcctcact

SEQ ID NO: 2556 - DNA, 24 bp, Artificial Sequence
  Description of Artificial Sequence: Synthetic oligonucleotide
caacagtatgatattctcctcact

SEQ ID NO: 2557 - DNA, 24 bp, Artificial Sequence
  Description of Artificial Sequence: Synthetic oligonucleotide
caacagtatgatattctcctcact

SEQ ID NO: 2558 - DNA, 24 bp, Artificial Sequence
  Description of Artificial Sequence: Synthetic oligonucleotide
caacagtatgatattctcctcact

SEQ ID NO: 2559 - DNA, 24 bp, Artificial Sequence
  Description of Artificial Sequence: Synthetic oligonucleotide
caacagtatgatattctcctcact

SEQ ID NO: 2560 - DNA, 24 bp, Artificial Sequence
  Description of Artificial Sequence: Synthetic oligonucleotide
caacagtatgatattctcctcact

SEQ ID NO: 2561 - DNA, 27 bp, Artificial Sequence
  Description of Artificial Sequence: Synthetic oligonucleotide
ctacagcataataattaccccttcact

SEQ ID NO: 2562 - DNA, 27 bp, Artificial Sequence
  Description of Artificial Sequence: Synthetic oligonucleotide
ctacagcataataattaccccttcact

SEQ ID NO: 2563 - DNA, 27 bp, Artificial Sequence
  Description of Artificial Sequence: Synthetic oligonucleotide
ctacagcataataattaccccttcact

SEQ ID NO: 2564 - DNA, 27 bp, Artificial Sequence
  Description of Artificial Sequence: Synthetic oligonucleotide
ctacagcataataattaccccttcact

SEQ ID NO: 2565 - DNA, 27 bp, Artificial Sequence
  Description of Artificial Sequence: Synthetic oligonucleotide
ctacagcataataattaccccttcact

SEQ ID NO: 2566 - DNA, 27 bp, Artificial Sequence
  Description of Artificial Sequence: Synthetic oligonucleotide
ctacagcataataattaccccttcact

SEQ ID NO: 2567 - DNA, 27 bp, Artificial Sequence
  Description of Artificial Sequence: Synthetic oligonucleotide
ctacagcataataattaccccttcact

SEQ ID NO: 2568 - DNA, 24 bp, Artificial Sequence
  Description of Artificial Sequence: Synthetic oligonucleotide
caacagtatgatgatctattcact

SEQ ID NO: 2569 - DNA, 24 bp, Artificial Sequence
  Description of Artificial Sequence: Synthetic oligonucleotide
caacagtatgatgatctattcact

SEQ ID NO: 2570 - DNA, 24 bp, Artificial Sequence
  Description of Artificial Sequence: Synthetic oligonucleotide
caacagtatgatgatctattcact

SEQ ID NO: 2571 - DNA, 24 bp, Artificial Sequence
  Description of Artificial Sequence: Synthetic oligonucleotide
caacagtatgatgatctattcact

SEQ ID NO: 2572 - DNA, 24 bp, Artificial Sequence
  Description of Artificial Sequence: Synthetic oligonucleotide
caacagtatgatgatctattcact

SEQ ID NO: 2573 - DNA, 24 bp, Artificial Sequence
  Description of Artificial Sequence: Synthetic oligonucleotide
caacagtatgatgatctattcact

SEQ ID NO: 2574 - DNA, 24 bp, Artificial Sequence
  Description of Artificial Sequence: Synthetic oligonucleotide
caacagtatgatgatctattcact

SEQ ID NO: 2575 - DNA, 24 bp, Artificial Sequence
  Description of Artificial Sequence: Synthetic oligonucleotide
caacagtatgatgatctattcact

SEQ ID NO: 2576 - DNA, 24 bp, Artificial Sequence
  Description of Artificial Sequence: Synthetic oligonucleotide
caacagtatgatgatctattcact

SEQ ID NO: 2577 - DNA, 24 bp, Artificial Sequence
  Description of Artificial Sequence: Synthetic oligonucleotide
caacagtatgatgatctattcact

SEQ ID NO: 2578 - DNA, 24 bp, Artificial Sequence
  Description of Artificial Sequence: Synthetic oligonucleotide
caacagtatgatgatctattcact

SEQ ID NO: 2579 - DNA, 24 bp, Artificial Sequence
  Description of Artificial Sequence: Synthetic oligonucleotide
cagcagtatggtagctcacctcgc

SEQ ID NO: 2580 - DNA, 24 bp, Artificial Sequence
  Description of Artificial Sequence: Synthetic oligonucleotide
cagcagtatggtagctcacctcgc

SEQ ID NO: 2581 - DNA, 24 bp, Artificial Sequence
  Description of Artificial Sequence: Synthetic oligonucleotide
cagcagtatggtagctcacctcgc

SEQ ID NO: 2582 - DNA, 24 bp, Artificial Sequence
  Description of Artificial Sequence: Synthetic oligonucleotide
cagcagtatggtagctcacctcgc

SEQ ID NO: 2583 - DNA, 27 bp, Artificial Sequence
  Description of Artificial Sequence: Synthetic oligonucleotide
cagcagtataataactggcctctcact

SEQ ID NO: 2584 - DNA, 27 bp, Artificial Sequence
  Description of Artificial Sequence: Synthetic oligonucleotide
cagcagtataataactggcctctcact

SEQ ID NO: 2585 - DNA, 27 bp, Artificial Sequence
  Description of Artificial Sequence: Synthetic oligonucleotide
cagcagtataataactggcctctcact

SEQ ID NO: 2586 - DNA, 27 bp, Artificial Sequence
  Description of Artificial Sequence: Synthetic oligonucleotide
cagcagtataataactggcctctcact

SEQ ID NO: 2587 - DNA, 27 bp, Artificial Sequence
  Description of Artificial Sequence: Synthetic oligonucleotide
cagcagtataataacttccctctcact

SEQ ID NO: 2588 - DNA, 27 bp, Artificial Sequence
  Description of Artificial Sequence: Synthetic oligonucleotide
cagcagtataataactatcctctcact

SEQ ID NO: 2589 - DNA, 27 bp, Artificial Sequence
  Description of Artificial Sequence: Synthetic oligonucleotide
cagcagtataataactggcctctcact

SEQ ID NO: 2590 - DNA, 27 bp, Artificial Sequence
  Description of Artificial Sequence: Synthetic oligonucleotide
cagcagtataataactggcctctcact

SEQ ID NO: 2591 - DNA, 27 bp, Artificial Sequence
  Description of Artificial Sequence: Synthetic oligonucleotide
cagcagtatggtagttcaccgctcact

SEQ ID NO: 2592 - DNA, 27 bp, Artificial Sequence
  Description of Artificial Sequence: Synthetic oligonucleotide
cagcagtatggtagttcaccgctcact

SEQ ID NO: 2593 - DNA, 27 bp, Artificial Sequence
  Description of Artificial Sequence: Synthetic oligonucleotide
cagcagtatggtagttcaccgctcact

SEQ ID NO: 2594 - DNA, 27 bp, Artificial Sequence
  Description of Artificial Sequence: Synthetic oligonucleotide
cagcagtatggtagttcaccgctcact

SEQ ID NO: 2595 - DNA, 27 bp, Artificial Sequence
  Description of Artificial Sequence: Synthetic oligonucleotide
cagcagtatggtagttcaccgctcact

SEQ ID NO: 2596 - DNA, 27 bp, Artificial Sequence
  Description of Artificial Sequence: Synthetic oligonucleotide
cagcagtatggtagttcaccgctcact

SEQ ID NO: 2597 - DNA, 27 bp, Artificial Sequence
  Description of Artificial Sequence: Synthetic oligonucleotide
cagcagtatggtagttcaccgctcact

SEQ ID NO: 2598 - DNA, 27 bp, Artificial Sequence
  Description of Artificial Sequence: Synthetic oligonucleotide
caacaatattatagtactccgtggacg

SEQ ID NO: 2599 - DNA, 27 bp, Artificial Sequence
  Description of Artificial Sequence: Synthetic oligonucleotide
caacaatattatagtactccgtggacg

SEQ ID NO: 2600 - DNA, 27 bp, Artificial Sequence
  Description of Artificial Sequence: Synthetic oligonucleotide
caacaatattatagtactccgtggacg

SEQ ID NO: 2601 - DNA, 27 bp, Artificial Sequence
  Description of Artificial Sequence: Synthetic oligonucleotide
caacaatattatagtactccgtggacg

SEQ ID NO: 2602 - DNA, 27 bp, Artificial Sequence
  Description of Artificial Sequence: Synthetic oligonucleotide
caacaatattatagtactccgtggacg

SEQ ID NO: 2603 - DNA, 27 bp, Artificial Sequence
  Description of Artificial Sequence: Synthetic oligonucleotide
caacaatattatagtactccgtggacg

SEQ ID NO: 2604 - DNA, 27 bp, Artificial Sequence
  Description of Artificial Sequence: Synthetic oligonucleotide
caacaatattatagtactccgtggacg

SEQ ID NO: 2605 - DNA, 27 bp, Artificial Sequence
  Description of Artificial Sequence: Synthetic oligonucleotide
caacaatattatagtactccgtggacg

SEQ ID NO: 2606 - DNA, 27 bp, Artificial Sequence
  Description of Artificial Sequence: Synthetic oligonucleotide
caacaatattatagtactccgtggacg

SEQ ID NO: 2607 - DNA, 27 bp, Artificial Sequence
  Description of Artificial Sequence: Synthetic oligonucleotide
caacaatattatagtactccgtggacg

SEQ ID NO: 2608 - DNA, 27 bp, Artificial Sequence
  Description of Artificial Sequence: Synthetic oligonucleotide
caacaatattatagtactccgtggacg

SEQ ID NO: 2609 - DNA, 27 bp, Artificial Sequence
  Description of Artificial Sequence: Synthetic oligonucleotide
cagcaatattatcgtactccgtggacg

SEQ ID NO: 2610 - DNA, 27 bp, Artificial Sequence
  Description of Artificial Sequence: Synthetic oligonucleotide
cagcaatattatcgtactccgtggacg

SEQ ID NO: 2611 - DNA, 27 bp, Artificial Sequence
  Description of Artificial Sequence: Synthetic oligonucleotide
cagcaatattatcgtactccgtggacg

SEQ ID NO: 2612 - DNA, 27 bp, Artificial Sequence
  Description of Artificial Sequence: Synthetic oligonucleotide
cagcaatattatcgtactccgtggacg

SEQ ID NO: 2613 - DNA, 27 bp, Artificial Sequence
  Description of Artificial Sequence: Synthetic oligonucleotide
cagcaatattatcgtactccgtggacg

SEQ ID NO: 2614 - DNA, 27 bp, Artificial Sequence
  Description of Artificial Sequence: Synthetic oligonucleotide
cagcaatattatcgtactccgtggacg

SEQ ID NO: 2615 - DNA, 27 bp, Artificial Sequence
  Description of Artificial Sequence: Synthetic oligonucleotide
cagcaatattatcgtactccgtggacg

SEQ ID NO: 2616 - DNA, 27 bp, Artificial Sequence
  Description of Artificial Sequence: Synthetic oligonucleotide
cagcaatattatcgtactccgtggacg

SEQ ID NO: 2617 - DNA, 27 bp, Artificial Sequence
  Description of Artificial Sequence: Synthetic oligonucleotide
cagcaatattatcgtactccgtggacg

SEQ ID NO: 2618 - DNA, 27 bp, Artificial Sequence
  Description of Artificial Sequence: Synthetic oligonucleotide
caacaatattatagtactccgtggacg

SEQ ID NO: 2619 - DNA, 27 bp, Artificial Sequence
  Description of Artificial Sequence: Synthetic oligonucleotide
caacaatattatagtactccgtggacg

SEQ ID NO: 2620 - DNA, 27 bp, Artificial Sequence
  Description of Artificial Sequence: Synthetic oligonucleotide
caacaatattatagtactccgtggacg

SEQ ID NO: 2621 - DNA, 27 bp, Artificial Sequence
  Description of Artificial Sequence: Synthetic oligonucleotide
caacaatattatagtactccgtggacg

SEQ ID NO: 2622 - DNA, 27 bp, Artificial Sequence
  Description of Artificial Sequence: Synthetic oligonucleotide
caacaatattatagtactccgtggacg

SEQ ID NO: 2623 - DNA, 27 bp, Artificial Sequence
  Description of Artificial Sequence: Synthetic oligonucleotide
cagcaatattatcgtactccgtggacg

SEQ ID NO: 2624 - DNA, 27 bp, Artificial Sequence
  Description of Artificial Sequence: Synthetic oligonucleotide
cagcaatattatcgtactccgtggacg

SEQ ID NO: 2625 - DNA, 27 bp, Artificial Sequence
  Description of Artificial Sequence: Synthetic oligonucleotide
cagcaatattatcgtactccgtggacg

SEQ ID NO: 2626 - DNA, 27 bp, Artificial Sequence
  Description of Artificial Sequence: Synthetic oligonucleotide
cagcaatattatcgtactccgtggacg

SEQ ID NO: 2627 - DNA, 27 bp, Artificial Sequence
  Description of Artificial Sequence: Synthetic oligonucleotide
cagcaatattatcgtactccgtggacg

SEQ ID NO: 2628 - DNA, 27 bp, Artificial Sequence
  Description of Artificial Sequence: Synthetic oligonucleotide
cagcaatattatcgtactccgtggacg

SEQ ID NO: 2629 - DNA, 27 bp, Artificial Sequence
  Description of Artificial Sequence: Synthetic oligonucleotide
cagcaatattatcgtactccgtggacg

SEQ ID NO: 2630 - DNA, 27 bp, Artificial Sequence
  Description of Artificial Sequence: Synthetic oligonucleotide
cagcaatattatcgtactccgtggacg

SEQ ID NO: 2631 - DNA, 27 bp, Artificial Sequence
  Description of Artificial Sequence: Synthetic oligonucleotide
cagcaatattatcgtactccgtggacg

SEQ ID NO: 2632 - DNA, 27 bp, Artificial Sequence
  Description of Artificial Sequence: Synthetic oligonucleotide
cagcaatattatcgtactccgtggacg

SEQ ID NO: 2633 - DNA, 27 bp, Artificial Sequence
  Description of Artificial Sequence: Synthetic oligonucleotide
cagcaatattatcgtactccgtggacg

SEQ ID NO: 2634 - DNA, 27 bp, Artificial Sequence
  Description of Artificial Sequence: Synthetic oligonucleotide
cagcaatattatcgtactccgtggacg

SEQ ID NO: 2635 - DNA, 27 bp, Artificial Sequence
  Description of Artificial Sequence: Synthetic oligonucleotide
cagcaatattatcgtactccgtggacg

SEQ ID NO: 2636 - DNA, 33 bp, Artificial Sequence
  Description of Artificial Sequence: Synthetic oligonucleotide
gcaacattcgatgaaagcctgagtggtccggta

SEQ ID NO: 2637 - DNA, 33 bp, Artificial Sequence
  Description of Artificial Sequence: Synthetic oligonucleotide
gcaacattcgatgaaagcctgcaaggtccggta

SEQ ID NO: 2638 - DNA, 33 bp, Artificial Sequence; identical to SEQ ID NO: 2636
  Description of Artificial Sequence: Synthetic oligonucleotide

SEQ ID NO: 2639 - DNA, 33 bp, Artificial Sequence; identical to SEQ ID NO: 2637
  Description of Artificial Sequence: Synthetic oligonucleotide

SEQ ID NO: 2640 - DNA, 33 bp, Artificial Sequence; identical to SEQ ID NO: 2513
  Description of Artificial Sequence: Synthetic oligonucleotide

SEQ ID NO: 2641 - DNA, 33 bp, Artificial Sequence; identical to SEQ ID NO: 2513
  Description of Artificial Sequence: Synthetic oligonucleotide

SEQ ID NO: 2642 - DNA, 33 bp, Artificial Sequence
  Description of Artificial Sequence: Synthetic oligonucleotide
gcaacattcgatgaaagcctgaatggtccggta

SEQ ID NO: 2643 - DNA, 33 bp, Artificial Sequence
  Description of Artificial Sequence: Synthetic oligonucleotide
gcaacattcgatgacagcctgcaaggtccggta

SEQ ID NO: 2644 - DNA, 33 bp, Artificial Sequence
  Description of Artificial Sequence: Synthetic oligonucleotide
gcaacattcgatgacagcctgagtggtccggta

SEQ ID NO: 2645 - DNA, 33 bp, Artificial Sequence
  Description of Artificial Sequence: Synthetic oligonucleotide
gcaacattcgatgacagcctgaatgctccggta

SEQ ID NO: 2646 - DNA, 33 bp, Artificial Sequence
  Description of Artificial Sequence: Synthetic oligonucleotide
gcaacattcgatagcagcctgaatggtccggta

SEQ ID NO: 2647 - DNA, 33 bp, Artificial Sequence
  Description of Artificial Sequence: Synthetic oligonucleotide
gcaacattcgatagcagcctgaatgctccggta

SEQ ID NO: 2648 - DNA, 33 bp, Artificial Sequence; identical to SEQ ID NO: 2647
  Description of Artificial Sequence: Synthetic oligonucleotide

SEQ ID NO: 2649 - DNA, 33 bp, Artificial Sequence; identical to SEQ ID NO: 2636
  Description of Artificial Sequence: Synthetic oligonucleotide

SEQ ID NO: 2650 - DNA, 27 bp, Artificial Sequence
  Description of Artificial Sequence: Synthetic oligonucleotide
ctacagcataataattaccccttcact

SEQ ID NO: 2651 - DNA, 27 bp, Artificial Sequence
  Description of Artificial Sequence: Synthetic oligonucleotide
ctacagcataataattaccccttcact

SEQ ID NO: 2652 - DNA, 33 bp, Artificial Sequence
  Description of Artificial Sequence: Synthetic oligonucleotide
gcaacattcgatagcagcctgagtggtccggta

SEQ ID NO: 2653 - DNA, 27 bp, Artificial Sequence
  Description of Artificial Sequence: Synthetic oligonucleotide
caacagagttacagtaccctgatcagt

SEQ ID NO: 2654 - DNA, 33 bp, Artificial Sequence
  Description of Artificial Sequence: Synthetic oligonucleotide
ggaacatgggatagcagcctgagtgctgtggta

SEQ ID NO: 2655 - DNA, 27 bp, Artificial Sequence
  Description of Artificial Sequence: Synthetic oligonucleotide
caacagagttacagtaccctgatcagt

SEQ ID NO: 2656 - DNA, 27 bp, Artificial Sequence
  Description of Artificial Sequence: Synthetic oligonucleotide
caacagagttacagtaccctgatcagt

SEQ ID NO: 2657 - DNA, 27 bp, Artificial Sequence
  Description of Artificial Sequence: Synthetic oligonucleotide
caacagagttacagtaccctgatcagt

SEQ ID NO: 2658 - DNA, 27 bp, Artificial Sequence
  Description of Artificial Sequence: Synthetic oligonucleotide
caacagagttacagtaccctgatcagt

SEQ ID NO: 2659 - DNA, 27 bp, Artificial Sequence
  Description of Artificial Sequence: Synthetic oligonucleotide
caacagagttacagtaccctgatcagt

SEQ ID NO: 2660 - DNA, 27 bp, Artificial Sequence
  Description of Artificial Sequence: Synthetic oligonucleotide
caacagagttacagtaccctgatcagt

SEQ ID NO: 2661 - DNA, 33 bp, Artificial Sequence; identical to SEQ ID NO: 2654
  Description of Artificial Sequence: Synthetic oligonucleotide

SEQ ID NO: 2662 - DNA, 33 bp, Artificial Sequence; identical to SEQ ID NO: 2654
  Description of Artificial Sequence: Synthetic oligonucleotide

SEQ ID NO: 2663 - DNA, 33 bp, Artificial Sequence; identical to SEQ ID NO: 2654
  Description of Artificial Sequence: Synthetic oligonucleotide

SEQ ID NO: 2664 - DNA, 33 bp, Artificial Sequence
  Description of Artificial Sequence: Synthetic oligonucleotide
ggaacattcgaaagcagcctgagtgctgtggta

SEQ ID NO: 2665 - DNA, 33 bp, Artificial Sequence; identical to SEQ ID NO: 2654
  Description of Artificial Sequence: Synthetic oligonucleotide

SEQ ID NO: 2666 - DNA, 33 bp, Artificial Sequence; identical to SEQ ID NO: 2654
  Description of Artificial Sequence: Synthetic oligonucleotide

SEQ ID NO: 2667 - DNA, 33 bp, Artificial Sequence; identical to SEQ ID NO: 2654
  Description of Artificial Sequence: Synthetic oligonucleotide

SEQ ID NO: 2668 - DNA, 33 bp, Artificial Sequence; identical to SEQ ID NO: 2664
  Description of Artificial Sequence: Synthetic oligonucleotide

SEQ ID NO: 2669 - DNA, 27 bp, Artificial Sequence
  Description of Artificial Sequence: Synthetic oligonucleotide
caacagagttacagtaccctgctcagt

SEQ ID NO: 2670 - DNA, 15 bp, Artificial Sequence
  Description of Artificial Sequence: Synthetic oligonucleotide
ggctactatatgcat

SEQ ID NO: 2671 - DNA, 15 bp, Artificial Sequence
  Description of Artificial Sequence: Synthetic oligonucleotide
aactttggcatgcac

SEQ ID NO: 2672 - DNA, 15 bp, Artificial Sequence
  Description of Artificial Sequence: Synthetic oligonucleotide
tactttggcatgcac

SEQ ID NO: 2673 - DNA, 15 bp, Artificial Sequence
  Description of Artificial Sequence: Synthetic oligonucleotide
agctatggcatgcac

SEQ ID NO: 2674 - DNA, 15 bp, Artificial Sequence
  Description of Artificial Sequence: Synthetic oligonucleotide
ggctactatatccac

SEQ ID NO: 2675 - DNA, 15 bp, Artificial Sequence
  Description of Artificial Sequence: Synthetic oligonucleotide
ggctactatatccac

SEQ ID NO: 2676 - DNA, 15 bp, Artificial Sequence
  Description of Artificial Sequence: Synthetic oligonucleotide
ggctactatatacac

SEQ ID NO: 2677 - DNA, 15 bp, Artificial Sequence
  Description of Artificial Sequence: Synthetic oligonucleotide
ggctactatatacac

SEQ ID NO: 2678 - DNA, 21 bp, Artificial Sequence
  Description of Artificial Sequence: Synthetic oligonucleotide
agtggtggttactactggagc

SEQ ID NO: 2679 - DNA, 15 bp, Artificial Sequence
  Description of Artificial Sequence: Synthetic oligonucleotide
aactatggcatgcac

SEQ ID NO: 2680 - DNA, 15 bp, Artificial Sequence
  Description of Artificial Sequence: Synthetic oligonucleotide
tactttggcatgcac

SEQ ID NO: 2681 - DNA, 15 bp, Artificial Sequence
  Description of Artificial Sequence: Synthetic oligonucleotide
agctatggcatgcac

SEQ ID NO: 2682 - DNA, 15 bp, Artificial Sequence
  Description of Artificial Sequence: Synthetic oligonucleotide
agttactactggagc

SEQ ID NO: 2683 - DNA, 15 bp, Artificial Sequence
  Description of Artificial Sequence: Synthetic oligonucleotide
agttactactggagc

SEQ ID NO: 2684 - DNA, 15 bp, Artificial Sequence
  Description of Artificial Sequence: Synthetic oligonucleotide
tactttggcatgcac

SEQ ID NO: 2685 - DNA, 15 bp, Artificial Sequence
  Description of Artificial Sequence: Synthetic oligonucleotide
tactttggcatgcac

SEQ ID NO: 2686 - DNA, 15 bp, Artificial Sequence
  Description of Artificial Sequence: Synthetic oligonucleotide
tactttggcatgcac

SEQ ID NO: 2687 - DNA, 15 bp, Artificial Sequence
  Description of Artificial Sequence: Synthetic oligonucleotide
tactttggcatgcac

SEQ ID NO: 2688 - DNA, 15 bp, Artificial Sequence
  Description of Artificial Sequence: Synthetic oligonucleotide
tactttggcatgcac

SEQ ID NO: 2689 - DNA, 15 bp, Artificial Sequence
  Description of Artificial Sequence: Synthetic oligonucleotide
tactttggcatgcac

SEQ ID NO: 2690 - DNA, 15 bp, Artificial Sequence
  Description of Artificial Sequence: Synthetic oligonucleotide
aactttggcatgcac

SEQ ID NO: 2691 - DNA, 15 bp, Artificial Sequence
  Description of Artificial Sequence: Synthetic oligonucleotide
aactttggcatgcac

SEQ ID NO: 2692 - DNA, 15 bp, Artificial Sequence
  Description of Artificial Sequence: Synthetic oligonucleotide
aactttggcatgcac

SEQ ID NO: 2693 - DNA, 15 bp, Artificial Sequence
  Description of Artificial Sequence: Synthetic oligonucleotide
aactttggcatgcac

SEQ ID NO: 2694 - DNA, 15 bp, Artificial Sequence
  Description of Artificial Sequence: Synthetic oligonucleotide
aactttggcatgcac

SEQ ID NO: 2695 - DNA, 15 bp, Artificial Sequence
  Description of Artificial Sequence: Synthetic oligonucleotide
aactttggcatgcac

SEQ ID NO: 2696 - DNA, 15 bp, Artificial Sequence
  Description of Artificial Sequence: Synthetic oligonucleotide
aactttggcatgcac

SEQ ID NO: 2697 - DNA, 15 bp, Artificial Sequence
  Description of Artificial Sequence: Synthetic oligonucleotide
aactttggcatgcac

SEQ ID NO: 2698 - DNA, 15 bp, Artificial Sequence
  Description of Artificial Sequence: Synthetic oligonucleotide
aactttggcatgcac

SEQ ID NO: 2699 - DNA, 15 bp, Artificial Sequence
  Description of Artificial Sequence: Synthetic oligonucleotide
aactttggcatgcac

SEQ ID NO: 2700 - DNA, 15 bp, Artificial Sequence
  Description of Artificial Sequence: Synthetic oligonucleotide
aactttggcatgcac

SEQ ID NO: 2701 - DNA, 15 bp, Artificial Sequence
  Description of Artificial Sequence: Synthetic oligonucleotide
aactttggcatgcac

SEQ ID NO: 2702 - DNA, 15 bp, Artificial Sequence
  Description of Artificial Sequence: Synthetic oligonucleotide
aactttggcatgcac

SEQ ID NO: 2703 - DNA, 15 bp, Artificial Sequence
  Description of Artificial Sequence: Synthetic oligonucleotide
aactttggcatgcac

SEQ ID NO: 2704 - DNA, 15 bp, Artificial Sequence
  Description of Artificial Sequence: Synthetic oligonucleotide
aactttggcatgcac

SEQ ID NO: 2705 - DNA, 15 bp, Artificial Sequence
  Description of Artificial Sequence: Synthetic oligonucleotide
aactttggcatgcac

SEQ ID NO: 2706 - DNA, 15 bp, Artificial Sequence
  Description of Artificial Sequence: Synthetic oligonucleotide
aactttggcatgcac

SEQ ID NO: 2707 - DNA, 15 bp, Artificial Sequence
  Description of Artificial Sequence: Synthetic oligonucleotide
aactttggcatgcac

SEQ ID NO: 2708 - DNA, 15 bp, Artificial Sequence
  Description of Artificial Sequence: Synthetic oligonucleotide
aactttggcatgcac

SEQ ID NO: 2709 - DNA, 15 bp, Artificial Sequence
  Description of Artificial Sequence: Synthetic oligonucleotide
agctatggcatgcac

SEQ ID NO: 2710 - DNA, 15 bp, Artificial Sequence
  Description of Artificial Sequence: Synthetic oligonucleotide
agctatggcatgcac

SEQ ID NO: 2711 - DNA, 15 bp, Artificial Sequence
  Description of Artificial Sequence: Synthetic oligonucleotide
agctatggcatgcac

SEQ ID NO: 2712 - DNA, 15 bp, Artificial Sequence
  Description of Artificial Sequence: Synthetic oligonucleotide
agctatggcatgcac

SEQ ID NO: 2713 - DNA, 15 bp, Artificial Sequence
  Description of Artificial Sequence: Synthetic oligonucleotide
agctatggcatgcac

SEQ ID NO: 2714 - DNA, 15 bp, Artificial Sequence
  Description of Artificial Sequence: Synthetic oligonucleotide
agctatggcatgcac

SEQ ID NO: 2715 - DNA, 15 bp, Artificial Sequence
  Description of Artificial Sequence: Synthetic oligonucleotide
agctatggcatgcac

SEQ ID NO: 2716 - DNA, 15 bp, Artificial Sequence
  Description of Artificial Sequence: Synthetic oligonucleotide
agctatggcatgcac

SEQ ID NO: 2717 - DNA, 15 bp, Artificial Sequence
  Description of Artificial Sequence: Synthetic oligonucleotide
agctatggcatgcac

SEQ ID NO: 2718 - DNA, 15 bp, Artificial Sequence
  Description of Artificial Sequence: Synthetic oligonucleotide
tactttggcatgcac

SEQ ID NO: 2719 - DNA, 15 bp, Artificial Sequence
  Description of Artificial Sequence: Synthetic oligonucleotide
tactttggcatgcac

SEQ ID NO: 2720 - DNA, 15 bp, Artificial Sequence
  Description of Artificial Sequence: Synthetic oligonucleotide
tactttggcatgcac

SEQ ID NO: 2721 - DNA, 15 bp, Artificial Sequence
  Description of Artificial Sequence: Synthetic oligonucleotide
tactttggcatgcac

SEQ ID NO: 2722 - DNA, 15 bp, Artificial Sequence
  Description of Artificial Sequence: Synthetic oligonucleotide
tactttggcatgcac

SEQ ID NO: 2723 - DNA, 15 bp, Artificial Sequence
  Description of Artificial Sequence: Synthetic oligonucleotide
tactttggcatgcac

SEQ ID NO: 2724 - DNA, 15 bp, Artificial Sequence
  Description of Artificial Sequence: Synthetic oligonucleotide
tactttggcatgcac

SEQ ID NO: 2725 - DNA, 15 bp, Artificial Sequence
  Description of Artificial Sequence: Synthetic oligonucleotide
agctatggcatgcac

SEQ ID NO: 2726 - DNA, 15 bp, Artificial Sequence
  Description of Artificial Sequence: Synthetic oligonucleotide
agctatggcatgcac

SEQ ID NO: 2727 - DNA, 15 bp, Artificial Sequence
  Description of Artificial Sequence: Synthetic oligonucleotide
agctatggcatgcac

SEQ ID NO: 2728 - DNA, 15 bp, Artificial Sequence
  Description of Artificial Sequence: Synthetic oligonucleotide
agctatggcatgcac

SEQ ID NO: 2729 - DNA, 15 bp, Artificial Sequence
  Description of Artificial Sequence: Synthetic oligonucleotide
agctatggcatgcac

SEQ ID NO: 2730 - DNA, 15 bp, Artificial Sequence
  Description of Artificial Sequence: Synthetic oligonucleotide
agctatggcatgcac

SEQ ID NO: 2731 - DNA, 15 bp, Artificial Sequence
  Description of Artificial Sequence: Synthetic oligonucleotide
agctatggcatgcac

SEQ ID NO: 2732 - DNA, 15 bp, Artificial Sequence
  Description of Artificial Sequence: Synthetic oligonucleotide
agctatggcatgcac

SEQ ID NO: 2733 - DNA, 15 bp, Artificial Sequence
  Description of Artificial Sequence: Synthetic oligonucleotide
agctatggcatgcac

SEQ ID NO: 2734 - DNA, 15 bp, Artificial Sequence
  Description of Artificial Sequence: Synthetic oligonucleotide
agctatggcatgcac

SEQ ID NO: 2735 - DNA, 15 bp, Artificial Sequence
  Description of Artificial Sequence: Synthetic oligonucleotide
agctatggcatgcac

SEQ ID NO: 2736 - DNA, 15 bp, Artificial Sequence
  Description of Artificial Sequence: Synthetic oligonucleotide
agctatggcatgcac

SEQ ID NO: 2737 - DNA, 15 bp, Artificial Sequence
  Description of Artificial Sequence: Synthetic oligonucleotide
agctatggcatgcac

SEQ ID NO: 2738 - DNA, 15 bp, Artificial Sequence
  Description of Artificial Sequence: Synthetic oligonucleotide
agctatggcatgcac

SEQ ID NO: 2739 - DNA, 15 bp, Artificial Sequence
  Description of Artificial Sequence: Synthetic oligonucleotide
agctatggcatgcac

SEQ ID NO: 2740 - DNA, 15 bp, Artificial Sequence
  Description of Artificial Sequence: Synthetic oligonucleotide
aactatggcatgcac

SEQ ID NO: 2741 - DNA, 15 bp, Artificial Sequence
  Description of Artificial Sequence: Synthetic oligonucleotide
aactatggcatgcac

SEQ ID NO: 2742 - DNA, 15 bp, Artificial Sequence
  Description of Artificial Sequence: Synthetic oligonucleotide
aactatggcatgcac

SEQ ID NO: 2743 - DNA, 15 bp, Artificial Sequence
  Description of Artificial Sequence: Synthetic oligonucleotide
aactatggcatgcac

SEQ ID NO: 2744 - DNA, 15 bp, Artificial Sequence
  Description of Artificial Sequence: Synthetic oligonucleotide
aactatggcatgcac

SEQ ID NO: 2745 - DNA, 15 bp, Artificial Sequence
  Description of Artificial Sequence: Synthetic oligonucleotide
aactatggcatgcac

SEQ ID NO: 2746 - DNA, 15 bp, Artificial Sequence
  Description of Artificial Sequence: Synthetic oligonucleotide
aactatggcatgcac

SEQ ID NO: 2747 - DNA, 15 bp, Artificial Sequence
  Description of Artificial Sequence: Synthetic oligonucleotide
aactatggcatgcac

SEQ ID NO: 2748 - DNA, 21 bp, Artificial Sequence
  Description of Artificial Sequence: Synthetic oligonucleotide
agtggtggttactactggagc

SEQ ID NO: 2749 - DNA, 21 bp, Artificial Sequence
  Description of Artificial Sequence: Synthetic oligonucleotide
agtggtggttactactggagc

SEQ ID NO: 2750 - DNA, 21 bp, Artificial Sequence
  Description of Artificial Sequence: Synthetic oligonucleotide
agtggtggttactactggagc

SEQ ID NO: 2751 - DNA, 21 bp, Artificial Sequence
  Description of Artificial Sequence: Synthetic oligonucleotide
agtggtggttactactggagc

SEQ ID NO: 2752 - DNA, 21 bp, Artificial Sequence
  Description of Artificial Sequence: Synthetic oligonucleotide
agtggtggttactactggagc

SEQ ID NO: 2753 - DNA, 21 bp, Artificial Sequence
  Description of Artificial Sequence: Synthetic oligonucleotide
agtggtggttactactggagc

SEQ ID NO: 2754 - DNA, 21 bp, Artificial Sequence
  Description of Artificial Sequence: Synthetic oligonucleotide
agtggtggttactactggagc

SEQ ID NO: 2755 - DNA, 15 bp, Artificial Sequence
  Description of Artificial Sequence: Synthetic oligonucleotide
ggctactatatccac

SEQ ID NO: 2756 - DNA, 15 bp, Artificial Sequence
  Description of Artificial Sequence: Synthetic oligonucleotide
ggctactatatccac

SEQ ID NO: 2757 - DNA, 15 bp, Artificial Sequence
  Description of Artificial Sequence: Synthetic oligonucleotide
ggctactatatccac

SEQ ID NO: 2758 - DNA, 15 bp, Artificial Sequence
  Description of Artificial Sequence: Synthetic oligonucleotide
ggctactatatccac

SEQ ID NO: 2759 - DNA, 15 bp, Artificial Sequence
  Description of Artificial Sequence: Synthetic oligonucleotide
ggctactatatccac

SEQ ID NO: 2760 - DNA, 15 bp, Artificial Sequence
  Description of Artificial Sequence: Synthetic oligonucleotide
ggctactatatccac

SEQ ID NO: 2761 - DNA, 15 bp, Artificial Sequence
  Description of Artificial Sequence: Synthetic oligonucleotide
ggctactatatccac

SEQ ID NO: 2762 - DNA, 15 bp, Artificial Sequence
  Description of Artificial Sequence: Synthetic oligonucleotide
ggctactatatccac

SEQ ID NO: 2763 - DNA, 15 bp, Artificial Sequence
  Description of Artificial Sequence: Synthetic oligonucleotide
ggctactatatccac

SEQ ID NO: 2764 - DNA, 15 bp, Artificial Sequence
  Description of Artificial Sequence: Synthetic oligonucleotide
ggctactatatccac

SEQ ID NO: 2765 - DNA, 15 bp, Artificial Sequence
  Description of Artificial Sequence: Synthetic oligonucleotide
ggctactatatccac

SEQ ID NO: 2766 - DNA, 15 bp, Artificial Sequence
  Description of Artificial Sequence: Synthetic oligonucleotide
ggctactatatacac

SEQ ID NO: 2767 - DNA, 15 bp, Artificial Sequence
  Description of Artificial Sequence: Synthetic oligonucleotide
ggctactatatacac

SEQ ID NO: 2768 - DNA, 15 bp, Artificial Sequence
  Description of Artificial Sequence: Synthetic oligonucleotide
ggctactatatacac

SEQ ID NO: 2769 - DNA, 15 bp, Artificial Sequence
  Description of Artificial Sequence: Synthetic oligonucleotide
ggctactatatacac

SEQ ID NO: 2770 - DNA, 15 bp, Artificial Sequence
  Description of Artificial Sequence: Synthetic oligonucleotide
ggctactatatacac

SEQ ID NO: 2771 - DNA, 15 bp, Artificial Sequence
  Description of Artificial Sequence: Synthetic oligonucleotide
ggctactatatacac

SEQ ID NO: 2772 - DNA, 15 bp, Artificial Sequence
  Description of Artificial Sequence: Synthetic oligonucleotide
ggctactatatacac

SEQ ID NO: 2773 - DNA, 15 bp, Artificial Sequence
  Description of Artificial Sequence: Synthetic oligonucleotide
ggctactatatacac

SEQ ID NO: 2774 - DNA, 15 bp, Artificial Sequence
  Description of Artificial Sequence: Synthetic oligonucleotide
ggctactatatacac

SEQ ID NO: 2775 - DNA, 15 bp, Artificial Sequence
  Description of Artificial Sequence: Synthetic oligonucleotide
ggctactatatccac

SEQ ID NO: 2776 - DNA, 15 bp, Artificial Sequence
  Description of Artificial Sequence: Synthetic oligonucleotide
ggctactatatccac

SEQ ID NO: 2777 - DNA, 15 bp, Artificial Sequence
  Description of Artificial Sequence: Synthetic oligonucleotide
ggctactatatccac

SEQ ID NO: 2778 - DNA, 15 bp, Artificial Sequence
  Description of Artificial Sequence: Synthetic oligonucleotide
ggctactatatccac

SEQ ID NO: 2779 - DNA, 15 bp, Artificial Sequence
  Description of Artificial Sequence: Synthetic oligonucleotide
ggctactatatccac

SEQ ID NO: 2780 - DNA, 15 bp, Artificial Sequence
  Description of Artificial Sequence: Synthetic oligonucleotide
ggctactatatacac

SEQ ID NO: 2781 - DNA, 15 bp, Artificial Sequence
  Description of Artificial Sequence: Synthetic oligonucleotide
ggctactatatacac

SEQ ID NO: 2782 - DNA, 15 bp, Artificial Sequence
  Description of Artificial Sequence: Synthetic oligonucleotide
ggctactatatacac

SEQ ID NO: 2783 - DNA, 15 bp, Artificial Sequence
  Description of Artificial Sequence: Synthetic oligonucleotide
ggctactatatacac

SEQ ID NO: 2784 - DNA, 15 bp, Artificial Sequence
  Description of Artificial Sequence: Synthetic oligonucleotide
ggctactatatacac

SEQ ID NO: 2785 - DNA, 15 bp, Artificial Sequence
  Description of Artificial Sequence: Synthetic oligonucleotide
ggctactatatacac

SEQ ID NO: 2786 - DNA, 15 bp, Artificial Sequence
  Description of Artificial Sequence: Synthetic oligonucleotide
ggctactatatacac

SEQ ID NO: 2787 - DNA, 15 bp, Artificial Sequence
  Description of Artificial Sequence: Synthetic oligonucleotide
ggctactatatacac

SEQ ID NO: 2788 - DNA, 15 bp, Artificial Sequence
  Description of Artificial Sequence: Synthetic oligonucleotide
ggctactatatacac

SEQ ID NO: 2789 - DNA, 15 bp, Artificial Sequence
  Description of Artificial Sequence: Synthetic oligonucleotide
ggctactatatacac

SEQ ID NO: 2790 - DNA, 15 bp, Artificial Sequence
  Description of Artificial Sequence: Synthetic oligonucleotide
ggctactatatacac

SEQ ID NO: 2791 - DNA, 15 bp, Artificial Sequence
  Description of Artificial Sequence: Synthetic oligonucleotide
ggctactatatacac

SEQ ID NO: 2792 - DNA, 15 bp, Artificial Sequence
  Description of Artificial Sequence: Synthetic oligonucleotide
ggctactatatacac

SEQ ID NO: 2793 - DNA, 15 bp, Artificial Sequence
  Description of Artificial Sequence: Synthetic oligonucleotide
ggctactatatgcat

SEQ ID NO: 2794 - DNA, 15 bp, Artificial Sequence
  Description of Artificial Sequence: Synthetic oligonucleotide
ggctactatatgcat

SEQ ID NO: 2795 - DNA, 15 bp, Artificial Sequence
  Description of Artificial Sequence: Synthetic oligonucleotide
ggctactatatgcat

SEQ ID NO: 2796 - DNA, 15 bp, Artificial Sequence
  Description of Artificial Sequence: Synthetic oligonucleotide
ggctactatatgcat

SEQ ID NO: 2797 - DNA, 15 bp, Artificial Sequence
  Description of Artificial Sequence: Synthetic oligonucleotide
ggctactatatgcat

SEQ ID NO: 2798 - DNA, 15 bp, Artificial Sequence
  Description of Artificial Sequence: Synthetic oligonucleotide
ggctactatatgcat

SEQ ID NO: 2799 - DNA, 15 bp, Artificial Sequence
  Description of Artificial Sequence: Synthetic oligonucleotide
ggctactatatgcat

SEQ ID NO: 2800 - DNA, 15 bp, Artificial Sequence
  Description of Artificial Sequence: Synthetic oligonucleotide
ggctactatatgcat

SEQ ID NO: 2801 - DNA, 15 bp, Artificial Sequence
  Description of Artificial Sequence: Synthetic oligonucleotide
ggctactatatgcat

SEQ ID NO: 2802 - DNA, 15 bp, Artificial Sequence
  Description of Artificial Sequence: Synthetic oligonucleotide
ggctactatatgcat

SEQ ID NO: 2803 - DNA, 15 bp, Artificial Sequence
  Description of Artificial Sequence: Synthetic oligonucleotide
ggctactatatgcat

SEQ ID NO: 2804 - DNA, 15 bp, Artificial Sequence
  Description of Artificial Sequence: Synthetic oligonucleotide
ggctactatatgcat

SEQ ID NO: 2805 - DNA, 15 bp, Artificial Sequence
  Description of Artificial Sequence: Synthetic oligonucleotide
ggctactatatgcat

SEQ ID NO: 2806 - DNA, 15 bp, Artificial Sequence
  Description of Artificial Sequence: Synthetic oligonucleotide
ggctactatatgcat

SEQ ID NO: 2807 - DNA, 15 bp, Artificial Sequence
  Description of Artificial Sequence: Synthetic oligonucleotide
aactttggcatgcac

SEQ ID NO: 2808 - DNA, 15 bp, Artificial Sequence
  Description of Artificial Sequence: Synthetic oligonucleotide
tactttggcatgcac

SEQ ID NO: 2809 - DNA, 15 bp, Artificial Sequence
  Description of Artificial Sequence: Synthetic oligonucleotide
ggctactatatgcat

SEQ ID NO: 2810 - DNA, 15 bp, Artificial Sequence
  Description of Artificial Sequence: Synthetic oligonucleotide
agctatggcatacac

SEQ ID NO: 2811 - DNA, 15 bp, Artificial Sequence
  Description of Artificial Sequence: Synthetic oligonucleotide
agttatgatatcaac

SEQ ID NO: 2812 - DNA, 15 bp, Artificial Sequence
  Description of Artificial Sequence: Synthetic oligonucleotide
agctatggcatacac

SEQ ID NO: 2813 - DNA, 15 bp, Artificial Sequence
  Description of Artificial Sequence: Synthetic oligonucleotide
agctatggcatacac

SEQ ID NO: 2814 - DNA, 15 bp, Artificial Sequence
  Description of Artificial Sequence: Synthetic oligonucleotide
agctatggcatacac

SEQ ID NO: 2815 - DNA, 15 bp, Artificial Sequence
  Description of Artificial Sequence: Synthetic oligonucleotide
agctatggcatacac

SEQ ID NO: 2816 - DNA, 15 bp, Artificial Sequence
  Description of Artificial Sequence: Synthetic oligonucleotide
agctatggcatacac

SEQ ID NO: 2817 - DNA, 15 bp, Artificial Sequence
  Description of Artificial Sequence: Synthetic oligonucleotide
agctatggcatacac

SEQ ID NO: 2818 - DNA, 15 bp, Artificial Sequence
  Description of Artificial Sequence: Synthetic oligonucleotide
agttatgatatcaac

SEQ ID NO: 2819 - DNA, 15 bp, Artificial Sequence
  Description of Artificial Sequence: Synthetic oligonucleotide
agttatgatatcaac

SEQ ID NO: 2820 - DNA, 15 bp, Artificial Sequence
  Description of Artificial Sequence: Synthetic oligonucleotide
agttatgatatcaac

SEQ ID NO: 2821 - DNA, 15 bp, Artificial Sequence
  Description of Artificial Sequence: Synthetic oligonucleotide
agttatgatatcaac

SEQ ID NO: 2822 - DNA, 15 bp, Artificial Sequence
  Description of Artificial Sequence: Synthetic oligonucleotide
agttatgatatcaac

SEQ ID NO: 2823 - DNA, 15 bp, Artificial Sequence
  Description of Artificial Sequence: Synthetic oligonucleotide
agttatgatatcaac

SEQ ID NO: 2824 - DNA, 15 bp, Artificial Sequence
  Description of Artificial Sequence: Synthetic oligonucleotide
agttatgatatcaac

SEQ ID NO: 2825 - DNA, 15 bp, Artificial Sequence
  Description of Artificial Sequence: Synthetic oligonucleotide
agttatgatatcaac

SEQ ID NO: 2826 - DNA, 15 bp, Artificial Sequence
  Description of Artificial Sequence: Synthetic oligonucleotide
agctatggcatacac

SEQ ID NO: 2827 - DNA, 51 bp, Artificial Sequence
  Description of Artificial Sequence: Synthetic oligonucleotide
tggatcaaccctaacagtggtggcacaaactatgcacagaagtttcagggc

SEQ ID NO: 2828 - DNA, 51 bp, Artificial Sequence
  Description of Artificial Sequence: Synthetic oligonucleotide
gttatatggtatgatggaagtaatgaaaactatgcagactccgtgaagggc

SEQ ID NO: 2829 - DNA, 51 bp, Artificial Sequence
  Description of Artificial Sequence: Synthetic oligonucleotide
gttatatggtatgatggaagtaataaatactatgcagactccgtgaagggc

SEQ ID NO: 2830 - DNA, 51 bp, Artificial Sequence; identical to SEQ ID NO: 2829
  Description of Artificial Sequence: Synthetic oligonucleotide

SEQ ID NO: 2831 - DNA, 51 bp, Artificial Sequence
  Description of Artificial Sequence: Synthetic oligonucleotide
tggatcaaccctgacagtggtggcacagactattcacagaggtttcagggc

SEQ ID NO: 2832 - DNA, 51 bp, Artificial Sequence; identical to SEQ ID NO: 2831
  Description of Artificial Sequence: Synthetic oligonucleotide

SEQ ID NO: 2833 - DNA, 51 bp, Artificial Sequence
  Description of Artificial Sequence: Synthetic oligonucleotide
tggatcagccctaacagtggtgacacaagctatgcacagaagtttcaggac

SEQ ID NO: 2834 - DNA, 51 bp, Artificial Sequence
  Description of Artificial Sequence: Synthetic oligonucleotide
tggataagccctaacaatggtgacacaaactatgcacagaagtttcaggac

SEQ ID NO: 2835 - DNA, 48 bp, Artificial Sequence
  Description of Artificial Sequence: Synthetic oligonucleotide
tacatctattacagtgggagcacctactacaacccgtccctcaagagt

SEQ ID NO: 2836 - DNA, 51 bp, Artificial Sequence
  Description of Artificial Sequence: Synthetic oligonucleotide
gctatatggtttgatggaagtgataaatactatgcagactccgtgaagggc

SEQ ID NO: 2837 - DNA, 51 bp, Artificial Sequence; identical to SEQ ID NO: 2829
  Description of Artificial Sequence: Synthetic oligonucleotide

SEQ ID NO: 2838 - DNA, 51 bp, Artificial Sequence
  Description of Artificial Sequence: Synthetic oligonucleotide
gctatatggtatgatggaaataataaatactatgcagactccgtgaagggc

SEQ ID NO: 2839 - DNA, 48 bp, Artificial Sequence
  Description of Artificial Sequence: Synthetic oligonucleotide
cgtatctataccagtgggagcaccaactacaacccctccctcaagagt

SEQ ID NO: 2840 - DNA, 48 bp, Artificial Sequence; identical to SEQ ID NO: 2839
  Description of Artificial Sequence: Synthetic oligonucleotide

SEQ ID NO: 2841 - DNA, 51 bp, Artificial Sequence
  Description of Artificial Sequence: Synthetic oligonucleotide
gttatatggtatgatgcaagtaataaatactatgcagacgccgtgaagggc

SEQ ID NO: 2842 - DNA, 51 bp, Artificial Sequence
  Description of Artificial Sequence: Synthetic oligonucleotide
gttatatggtatgatgcaagtaataaatactatgcagactccgtgaagggc

SEQ ID NO: 2843 - DNA, 51 bp, Artificial Sequence
  Description of Artificial Sequence: Synthetic oligonucleotide
gttatatggtatgatggaagtaataaatactatgcagacgccgtgaagggc

SEQ ID NO: 2844 - DNA, 51 bp, Artificial Sequence; identical to SEQ ID NO: 2841
  Description of Artificial Sequence: Synthetic oligonucleotide

SEQ ID NO: 2845 - DNA, 51 bp, Artificial Sequence; identical to SEQ ID NO: 2841
  Description of Artificial Sequence: Synthetic oligonucleotide

SEQ ID NO: 2846 - DNA, 51 bp, Artificial Sequence; identical to SEQ ID NO: 2841
  Description of Artificial Sequence: Synthetic oligonucleotide

SEQ ID NO: 2847 - DNA, 51 bp, Artificial Sequence
  Description of Artificial Sequence: Synthetic oligonucleotide
gttatatggtatgatgcaagtaatgaaaactatgcagacgccgtgaagggc

SEQ ID NO: 2848 - DNA, 51 bp, Artificial Sequence; identical to SEQ ID NO: 2847
  Description of Artificial Sequence: Synthetic oligonucleotide

SEQ ID NO: 2849 - DNA, 51 bp, Artificial Sequence; identical to SEQ ID NO: 2847
  Description of Artificial Sequence: Synthetic oligonucleotide

SEQ ID NO: 2850 - DNA, 51 bp, Artificial Sequence
  Description of Artificial Sequence: Synthetic oligonucleotide
gttatatggtatgatgcaagtaatgaaaactatgcagactccgtgaagggc

SEQ ID NO: 2851 - DNA, 51 bp, Artificial Sequence
  Description of Artificial Sequence: Synthetic oligonucleotide
gttatatggtatgatggaagtaatgaaaactatgcagacgccgtgaagggc

SEQ ID NO: 2852 - DNA, 51 bp, Artificial Sequence; identical to SEQ ID NO: 2847
  Description of Artificial Sequence: Synthetic oligonucleotide

SEQ ID NO: 2853 - DNA, 51 bp, Artificial Sequence; identical to SEQ ID NO: 2847
  Description of Artificial Sequence: Synthetic oligonucleotide

SEQ ID NO: 2854 - DNA, 51 bp, Artificial Sequence; identical to SEQ ID NO: 2828
  Description of Artificial Sequence: Synthetic oligonucleotide

SEQ ID NO: 2855 - DNA, 51 bp, Artificial Sequence; identical to SEQ ID NO: 2847
  Description of Artificial Sequence: Synthetic oligonucleotide

SEQ ID NO: 2856 - DNA, 51 bp, Artificial Sequence; identical to SEQ ID NO: 2847
  Description of Artificial Sequence: Synthetic oligonucleotide

SEQ ID NO: 2857 - DNA, 51 bp, Artificial Sequence; identical to SEQ ID NO: 2847
  Description of Artificial Sequence: Synthetic oligonucleotide

SEQ ID NO: 2858 - DNA, 51 bp, Artificial Sequence; identical to SEQ ID NO: 2847
  Description of Artificial Sequence: Synthetic oligonucleotide

SEQ ID NO: 2859 - DNA, 51 bp, Artificial Sequence; identical to SEQ ID NO: 2847
  Description of Artificial Sequence: Synthetic oligonucleotide

SEQ ID NO: 2860 - DNA, 51 bp, Artificial Sequence; identical to SEQ ID NO: 2847
  Description of Artificial Sequence: Synthetic oligonucleotide

SEQ ID NO: 2861 - DNA, 51 bp, Artificial Sequence; identical to SEQ ID NO: 2847
  Description of Artificial Sequence: Synthetic oligonucleotide

SEQ ID NO: 2862 - DNA, 51 bp, Artificial Sequence; identical to SEQ ID NO: 2851
  Description of Artificial Sequence: Synthetic oligonucleotide

SEQ ID NO: 2863 - DNA, 51 bp, Artificial Sequence; identical to SEQ ID NO: 2850
  Description of Artificial Sequence: Synthetic oligonucleotide

SEQ ID NO: 2864 - DNA, 51 bp, Artificial Sequence; identical to SEQ ID NO: 2847
  Description of Artificial Sequence: Synthetic oligonucleotide

SEQ ID NO: 2865 - DNA, 51 bp, Artificial Sequence; identical to SEQ ID NO: 2847
  Description of Artificial Sequence: Synthetic oligonucleotide

SEQ ID NO: 2866 - DNA, 51 bp, Artificial Sequence; identical to SEQ ID NO: 2841
  Description of Artificial Sequence: Synthetic oligonucleotide

SEQ ID NO: 2867 - DNA, 51 bp, Artificial Sequence; identical to SEQ ID NO: 2841
  Description of Artificial Sequence: Synthetic oligonucleotide

SEQ ID NO: 2868 - DNA, 51 bp, Artificial Sequence; identical to SEQ ID NO: 2841
  Description of Artificial Sequence: Synthetic oligonucleotide

SEQ ID NO: 2869 - DNA, 51 bp, Artificial Sequence; identical to SEQ ID NO: 2841
  Description of Artificial Sequence: Synthetic oligonucleotide

SEQ ID NO: 2870 - DNA, 51 bp, Artificial Sequence; identical to SEQ ID NO: 2841
  Description of Artificial Sequence: Synthetic oligonucleotide

SEQ ID NO: 2871 - DNA, 51 bp, Artificial Sequence; identical to SEQ ID NO: 2841
  Description of Artificial Sequence: Synthetic oligonucleotide

SEQ ID NO: 2872 - DNA, 51 bp, Artificial Sequence; identical to SEQ ID NO: 2841
  Description of Artificial Sequence: Synthetic oligonucleotide

SEQ ID NO: 2873 - DNA, 51 bp, Artificial Sequence; identical to SEQ ID NO: 2842
  Description of Artificial Sequence: Synthetic oligonucleotide

SEQ ID NO: 2874 - DNA, 51 bp, Artificial Sequence; identical to SEQ ID NO: 2843
  Description of Artificial Sequence: Synthetic oligonucleotide

SEQ ID NO: 2875 - DNA, 51 bp, Artificial Sequence; identical to SEQ ID NO: 2841
  Description of Artificial Sequence: Synthetic oligonucleotide

SEQ ID NO: 2876 - DNA, 51 bp, Artificial Sequence; identical to SEQ ID NO: 2841
  Description of Artificial Sequence: Synthetic oligonucleotide

SEQ ID NO: 2877 - DNA, 51 bp, Artificial Sequence; identical to SEQ ID NO: 2841
  Description of Artificial Sequence: Synthetic oligonucleotide

SEQ ID NO: 2878 - DNA, 51 bp, Artificial Sequence; identical to SEQ ID NO: 2841
  Description of Artificial Sequence: Synthetic oligonucleotide

SEQ ID NO: 2879 - DNA, 51 bp, Artificial Sequence; identical to SEQ ID NO: 2829
  Description of Artificial Sequence: Synthetic oligonucleotide

SEQ ID NO: 2880 - DNA, 51 bp, Artificial Sequence; identical to SEQ ID NO: 2842
  Description of Artificial Sequence: Synthetic oligonucleotide

SEQ ID NO: 2881 - DNA, 51 bp, Artificial Sequence; identical to SEQ ID NO: 2843
  Description of Artificial Sequence: Synthetic oligonucleotide

SEQ ID NO: 2882 - DNA, 51 bp, Artificial Sequence
  Description of Artificial Sequence: Synthetic oligonucleotide
gctatatggtatgatgcaaataataaatactatgcagacgccgtgaagggc

SEQ ID NO: 2883 - DNA, 51 bp, Artificial Sequence; identical to SEQ ID NO: 2882
  Description of Artificial Sequence: Synthetic oligonucleotide

SEQ ID NO: 2884 - DNA, 51 bp, Artificial Sequence; identical to SEQ ID NO: 2882
  Description of Artificial Sequence: Synthetic oligonucleotide

SEQ ID NO: 2885 - DNA, 51 bp, Artificial Sequence; identical to SEQ ID NO: 2882
  Description of Artificial Sequence: Synthetic oligonucleotide

SEQ ID NO: 2886 - DNA, 51 bp, Artificial Sequence; identical to SEQ ID NO: 2882
  Description of Artificial Sequence: Synthetic oligonucleotide

SEQ ID NO: 2887 - DNA, 51 bp, Artificial Sequence; identical to SEQ ID NO: 2882
  Description of Artificial Sequence: Synthetic oligonucleotide

SEQ ID NO: 2888 - DNA, 51 bp, Artificial Sequence; identical to SEQ ID NO: 2882
  Description of Artificial Sequence: Synthetic oligonucleotide

SEQ ID NO: 2889 - DNA, 51 bp, Artificial Sequence
  Description of Artificial Sequence: Synthetic oligonucleotide
gctatatggtatgatggaaataataaatactatgcagacgccgtgaagggc

SEQ ID NO: 2890 - DNA, 51 bp, Artificial Sequence
  Description of Artificial Sequence: Synthetic oligonucleotide
gctatatggtatgatgcaaataataaatactatgcagactccgtgaagggc

SEQ ID NO: 2891 - DNA, 51 bp, Artificial Sequence; identical to SEQ ID NO: 2882
  Description of Artificial Sequence: Synthetic oligonucleotide

SEQ ID NO: 2892 - DNA, 51 bp, Artificial Sequence; identical to SEQ ID NO: 2882
  Description of Artificial Sequence: Synthetic oligonucleotide

SEQ ID NO: 2893 - DNA, 51 bp, Artificial Sequence
  Description of Artificial Sequence: Synthetic oligonucleotide
gttatatggtatgatgcaagtaataaatactatgaagacgccgtgaagggc

SEQ ID NO: 2894 - DNA, 51 bp, Artificial Sequence
  Description of Artificial Sequence: Synthetic oligonucleotide
gttatatggtatgatggaagtaataaatactatgaagactccgtgaagggc

SEQ ID NO: 2895 - DNA, 51 bp, Artificial Sequence
  Description of Artificial Sequence: Synthetic oligonucleotide
gttatatggtatgatggaagtaataaatactatgaagacgccgtgaagggc

SEQ ID NO: 2896 - DNA, 51 bp, Artificial Sequence
  Description of Artificial Sequence: Synthetic oligonucleotide
gttatatggtatgatgcaagtaataaatactatgaagactccgtgaagggc

SEQ ID NO: 2897 - DNA, 51 bp, Artificial Sequence
  Description of Artificial Sequence: Synthetic oligonucleotide
gctatatggtttgatgcaagtgataaatactatgcagacgccgtgaagggc

SEQ ID NO: 2898 - DNA, 51 bp, Artificial Sequence
  Description of Artificial Sequence: Synthetic oligonucleotide
gctatatggtttgatgcaagtgataaatactatgcagactccgtgaagggc

SEQ ID NO: 2899 - DNA, 51 bp, Artificial Sequence
  Description of Artificial Sequence: Synthetic oligonucleotide
gctatatggtttgatggaagtgataaatactatgcagacgccgtgaagggc

SEQ ID NO: 2900 - DNA, 51 bp, Artificial Sequence; identical to SEQ ID NO: 2897
  Description of Artificial Sequence: Synthetic oligonucleotide

SEQ ID NO: 2901 - DNA, 51 bp, Artificial Sequence; identical to SEQ ID NO: 2897
  Description of Artificial Sequence: Synthetic oligonucleotide

SEQ ID NO: 2902 - DNA, 51 bp, Artificial Sequence; identical to SEQ ID NO: 2897
  Description of Artificial Sequence: Synthetic oligonucleotide

SEQ ID NO: 2903 - DNA, 51 bp, Artificial Sequence; identical to SEQ ID NO: 2897
  Description of Artificial Sequence: Synthetic oligonucleotide

SEQ ID NO: 2904 - DNA, 51 bp, Artificial Sequence; identical to SEQ ID NO: 2897
  Description of Artificial Sequence: Synthetic oligonucleotide

SEQ ID NO: 2905 - DNA, 48 bp, Artificial Sequence; identical to SEQ ID NO: 2835
  Description of Artificial Sequence: Synthetic oligonucleotide

SEQ ID NO: 2906 - DNA, 48 bp, Artificial Sequence; identical to SEQ ID NO: 2835
  Description of Artificial Sequence: Synthetic oligonucleotide

SEQ ID NO: 2907 - DNA, 48 bp, Artificial Sequence; identical to SEQ ID NO: 2835
  Description of Artificial Sequence: Synthetic oligonucleotide

SEQ ID NO: 2908 - DNA, 48 bp, Artificial Sequence; identical to SEQ ID NO: 2835
  Description of Artificial Sequence: Synthetic oligonucleotide

SEQ ID NO: 2909 - DNA, 48 bp, Artificial Sequence; identical to SEQ ID NO: 2835
  Description of Artificial Sequence: Synthetic oligonucleotide

SEQ ID NO: 2910 - DNA, 48 bp, Artificial Sequence; identical to SEQ ID NO: 2835
  Description of Artificial Sequence: Synthetic oligonucleotide

SEQ ID NO: 2911 - DNA, 48 bp, Artificial Sequence; identical to SEQ ID NO: 2835
  Description of Artificial Sequence: Synthetic oligonucleotide

SEQ ID NO: 2912 - DNA, 51 bp, Artificial Sequence
  Description of Artificial Sequence: Synthetic oligonucleotide
tggatcaaccctgaaagtggtggcacagactattcacagaggtttcagggc

SEQ ID NO: 2913 - DNA, 51 bp, Artificial Sequence; identical to SEQ ID NO: 2912
  Description of Artificial Sequence: Synthetic oligonucleotide

SEQ ID NO: 2914 - DNA, 51 bp, Artificial Sequence
  Description of Artificial Sequence: Synthetic oligonucleotide
tggatcaaccctgacgctggtggcacagactattcacagaggtttcagggc

SEQ ID NO: 2915 - DNA, 51 bp, Artificial Sequence; identical to SEQ ID NO: 2914
  Description of Artificial Sequence: Synthetic oligonucleotide

SEQ ID NO: 2916 - DNA, 51 bp, Artificial Sequence; identical to SEQ ID NO: 2831
  Description of Artificial Sequence: Synthetic oligonucleotide

SEQ ID NO: 2917 - DNA, 51 bp, Artificial Sequence; identical to SEQ ID NO: 2831
  Description of Artificial Sequence: Synthetic oligonucleotide

SEQ ID NO: 2918 - DNA, 51 bp, Artificial Sequence; identical to SEQ ID NO: 2831
  Description of Artificial Sequence: Synthetic oligonucleotide

SEQ ID NO: 2919 - DNA, 51 bp, Artificial Sequence; identical to SEQ ID NO: 2914
  Description of Artificial Sequence: Synthetic oligonucleotide

SEQ ID NO: 2920 - DNA, 51 bp, Artificial Sequence; identical to SEQ ID NO: 2914
  Description of Artificial Sequence: Synthetic oligonucleotide

SEQ ID NO: 2921 - DNA, 51 bp, Artificial Sequence; identical to SEQ ID NO: 2914
  Description of Artificial Sequence: Synthetic oligonucleotide

SEQ ID NO: 2922 - DNA, 51 bp, Artificial Sequence; identical to SEQ ID NO: 2912
  Description of Artificial Sequence: Synthetic oligonucleotide

SEQ ID NO: 2923 - DNA, 51 bp, Artificial Sequence
  Description of Artificial Sequence: Synthetic oligonucleotide
tggatcagccctaacagtggtgaaacaagctatgcacagaagtttcaggac

SEQ ID NO: 2924 - DNA, 51 bp, Artificial Sequence; identical to SEQ ID NO: 2833
  Description of Artificial Sequence: Synthetic oligonucleotide

SEQ ID NO: 2925 - DNA, 51 bp, Artificial Sequence; identical to SEQ ID NO: 2923
  Description of Artificial Sequence: Synthetic oligonucleotide

SEQ ID NO: 2926 - DNA, 51 bp, Artificial Sequence; identical to SEQ ID NO: 2923
  Description of Artificial Sequence: Synthetic oligonucleotide

SEQ ID NO: 2927 - DNA, 51 bp, Artificial Sequence; identical to SEQ ID NO: 2833
  Description of Artificial Sequence: Synthetic oligonucleotide

SEQ ID NO: 2928 - DNA, 51 bp, Artificial Sequence; identical to SEQ ID NO: 2923
  Description of Artificial Sequence: Synthetic oligonucleotide

SEQ ID NO: 2929 - DNA, 51 bp, Artificial Sequence; identical to SEQ ID NO: 2833
  Description of Artificial Sequence: Synthetic oligonucleotide

SEQ ID NO: 2930 - DNA, 51 bp, Artificial Sequence; identical to SEQ ID NO: 2923
  Description of Artificial Sequence: Synthetic oligonucleotide

SEQ ID NO: 2931 - DNA, 51 bp, Artificial Sequence; identical to SEQ ID NO: 2923
  Description of Artificial Sequence: Synthetic oligonucleotide

SEQ ID NO: 2932 - DNA, 51 bp, Artificial Sequence; identical to SEQ ID NO: 2912
  Description of Artificial Sequence: Synthetic oligonucleotide

SEQ ID NO: 2933 - DNA, 51 bp, Artificial Sequence; identical to SEQ ID NO: 2912
  Description of Artificial Sequence: Synthetic oligonucleotide

SEQ ID NO: 2934 - DNA, 51 bp, Artificial Sequence; identical to SEQ ID NO: 2831
  Description of Artificial Sequence: Synthetic oligonucleotide

SEQ ID NO: 2935 - DNA, 51 bp, Artificial Sequence; identical to SEQ ID NO: 2912
  Description of Artificial Sequence: Synthetic oligonucleotide

SEQ ID NO: 2936 - DNA, 51 bp, Artificial Sequence; identical to SEQ ID NO: 2912
  Description of Artificial Sequence: Synthetic oligonucleotide

SEQ ID NO: 2937 - DNA, 51 bp, Artificial Sequence
  Description of Artificial Sequence: Synthetic oligonucleotide
tggataagccctaaccaaggtgaaacaaactatgcacagaagtttcaggac

SEQ ID NO: 2938 - DNA, 51 bp, Artificial Sequence
  Description of Artificial Sequence: Synthetic oligonucleotide
tggataagccctaaccaaggtgacacaaactatgcacagaagtttcaggac

SEQ ID NO: 2939 - DNA, 51 bp, Artificial Sequence; identical to SEQ ID NO: 2937
  Description of Artificial Sequence: Synthetic oligonucleotide

SEQ ID NO: 2940 - DNA, 51 bp, Artificial Sequence
  Description of Artificial Sequence: Synthetic oligonucleotide
tggataagccctaacaatggtgaaacaaactatgcacagaagtttcaggac

SEQ ID NO: 2941 - DNA, 51 bp, Artificial Sequence; identical to SEQ ID NO: 2834
  Description of Artificial Sequence: Synthetic oligonucleotide

SEQ ID NO: 2942 - DNA, 51 bp, Artificial Sequence; identical to SEQ ID NO: 2938
  Description of Artificial Sequence: Synthetic oligonucleotide

SEQ ID NO: 2943 - DNA, 51 bp, Artificial Sequence; identical to SEQ ID NO: 2940
  Description of Artificial Sequence: Synthetic oligonucleotide

SEQ ID NO: 2944 - DNA, 51 bp, Artificial Sequence; identical to SEQ ID NO: 2937
  Description of Artificial Sequence: Synthetic oligonucleotide

SEQ ID NO: 2945 - DNA, 51 bp, Artificial Sequence; identical to SEQ ID NO: 2834
  Description of Artificial Sequence: Synthetic oligonucleotide

SEQ ID NO: 2946 - DNA, 51 bp, Artificial Sequence; identical to SEQ ID NO: 2938
  Description of Artificial Sequence: Synthetic oligonucleotide

SEQ ID NO: 2947 - DNA, 51 bp, Artificial Sequence; identical to SEQ ID NO: 2940
  Description of Artificial Sequence: Synthetic oligonucleotide

SEQ ID NO: 2948 - DNA, 51 bp, Artificial Sequence; identical to SEQ ID NO: 2937
  Description of Artificial Sequence: Synthetic oligonucleotide

SEQ ID NO: 2949 - DNA, 51 bp, Artificial Sequence; identical to SEQ ID NO: 2937
  Description of Artificial Sequence: Synthetic oligonucleotide

SEQ ID NO: 2950 - DNA, 51 bp, Artificial Sequence; identical to SEQ ID NO: 2827
  Description of Artificial Sequence: Synthetic oligonucleotide

SEQ ID NO: 2951 - DNA, 51 bp, Artificial Sequence; identical to SEQ ID NO: 2827
  Description of Artificial Sequence: Synthetic oligonucleotide

SEQ ID NO: 2952 - DNA, 51 bp, Artificial Sequence; identical to SEQ ID NO: 2827
  Description of Artificial Sequence: Synthetic oligonucleotide

SEQ ID NO: 2953 - DNA, 51 bp, Artificial Sequence; identical to SEQ ID NO: 2827
  Description of Artificial Sequence: Synthetic oligonucleotide

SEQ ID NO: 2954 - DNA, 51 bp, Artificial Sequence; identical to SEQ ID NO: 2827
  Description of Artificial Sequence: Synthetic oligonucleotide

SEQ ID NO: 2955 - DNA, 51 bp, Artificial Sequence; identical to SEQ ID NO: 2827
  Description of Artificial Sequence: Synthetic oligonucleotide

SEQ ID NO: 2956 - DNA, 51 bp, Artificial Sequence; identical to SEQ ID NO: 2827
  Description of Artificial Sequence: Synthetic oligonucleotide

SEQ ID NO: 2957 - DNA, 51 bp, Artificial Sequence; identical to SEQ ID NO: 2827
  Description of Artificial Sequence: Synthetic oligonucleotide

SEQ ID NO: 2958 - DNA, 51 bp, Artificial Sequence; identical to SEQ ID NO: 2827
  Description of Artificial Sequence: Synthetic oligonucleotide

SEQ ID NO: 2959 - DNA, 51 bp, Artificial Sequence; identical to SEQ ID NO: 2827
  Description of Artificial Sequence: Synthetic oligonucleotide

SEQ ID NO: 2960 - DNA, 51 bp, Artificial Sequence; identical to SEQ ID NO: 2827
  Description of Artificial Sequence: Synthetic oligonucleotide

SEQ ID NO: 2961 - DNA, 51 bp, Artificial Sequence; identical to SEQ ID NO: 2827
  Description of Artificial Sequence: Synthetic oligonucleotide

SEQ ID NO: 2962 - DNA, 51 bp, Artificial Sequence; identical to SEQ ID NO: 2827
  Description of Artificial Sequence: Synthetic oligonucleotide

SEQ ID NO: 2963 - DNA, 51 bp, Artificial Sequence; identical to SEQ ID NO: 2827
  Description of Artificial Sequence: Synthetic oligonucleotide

SEQ ID NO: 2964 - DNA, 51 bp, Artificial Sequence; identical to SEQ ID NO: 2847
  Description of Artificial Sequence: Synthetic oligonucleotide

SEQ ID NO: 2965 - DNA, 51 bp, Artificial Sequence; identical to SEQ ID NO: 2841
  Description of Artificial Sequence: Synthetic oligonucleotide

SEQ ID NO: 2966 - DNA, 51 bp, Artificial Sequence; identical to SEQ ID NO: 2827
  Description of Artificial Sequence: Synthetic oligonucleotide

SEQ ID NO: 2967 - DNA, 51 bp, Artificial Sequence
  Description of Artificial Sequence: Synthetic oligonucleotide
gttatatggtatgatggaagtaataagttccatgcagactccgtgaagggc

SEQ ID NO: 2968 - DNA, 51 bp, Artificial Sequence
  Description of Artificial Sequence: Synthetic oligonucleotide
tggatgaaccctaacagtggtaacacaggctatgcacagaagttccagggc

SEQ ID NO: 2969 - DNA, 51 bp, Artificial Sequence
  Description of Artificial Sequence: Synthetic oligonucleotide
gttatatggtatgatgcaagtaataagttccatgcagacgccgtgaagggc

SEQ ID NO: 2970 - DNA, 51 bp, Artificial Sequence; identical to SEQ ID NO: 2969
  Description of Artificial Sequence: Synthetic oligonucleotide

SEQ ID NO: 2971 - DNA, 51 bp, Artificial Sequence; identical to SEQ ID NO: 2969
  Description of Artificial Sequence: Synthetic oligonucleotide

SEQ ID NO: 2972 - DNA, 51 bp, Artificial Sequence; identical to SEQ ID NO: 2969
  Description of Artificial Sequence: Synthetic oligonucleotide

SEQ ID NO: 2973 - DNA, 51 bp, Artificial Sequence
  Description of Artificial Sequence: Synthetic oligonucleotide
gttatatggtatgatgcaagtaataagttccatgcagactccgtgaagggc

SEQ ID NO: 2974 - DNA, 51 bp, Artificial Sequence
  Description of Artificial Sequence: Synthetic oligonucleotide
gttatatggtatgatggaagtaataagttccatgcagacgccgtgaagggc

SEQ ID NO: 2975 - DNA, 51 bp, Artificial Sequence
  Description of Artificial Sequence: Synthetic oligonucleotide
tggatgaaccctaacagtggtggcacaggctatgcacagaagttccagggc

SEQ ID NO: 2976 - DNA, 51 bp, Artificial Sequence; identical to SEQ ID NO: 2968
  Description of Artificial Sequence: Synthetic oligonucleotide

SEQ ID NO: 2977 - DNA, 51 bp, Artificial Sequence; identical to SEQ ID NO: 2975
  Description of Artificial Sequence: Synthetic oligonucleotide

SEQ ID NO: 2978 - DNA, 51 bp, Artificial Sequence; identical to SEQ ID NO: 2975
  Description of Artificial Sequence: Synthetic oligonucleotide

SEQ ID NO: 2979 - DNA, 51 bp, Artificial Sequence; identical to SEQ ID NO: 2975
  Description of Artificial Sequence: Synthetic oligonucleotide

SEQ ID NO: 2980 - DNA, 51 bp, Artificial Sequence; identical to SEQ ID NO: 2968
  Description of Artificial Sequence: Synthetic oligonucleotide

SEQ ID NO: 2981 - DNA, 51 bp, Artificial Sequence; identical to SEQ ID NO: 2975
  Description of Artificial Sequence: Synthetic oligonucleotide

SEQ ID NO: 2982 - DNA, 51 bp, Artificial Sequence; identical to SEQ ID NO: 2975
  Description of Artificial Sequence: Synthetic oligonucleotide

SEQ ID NO: 2983 - DNA, 51 bp, Artificial Sequence; identical to SEQ ID NO: 2969
  Description of Artificial Sequence: Synthetic oligonucleotide

SEQ ID NO: 2984 - DNA, 57 bp, Artificial Sequence
  Description of Artificial Sequence: Synthetic oligonucleotide
gggggggattacgtttgggggacttatcggcctcactactactacggtatggacgtc

SEQ ID NO: 2985 - DNA, 36 bp, Artificial Sequence
  Description of Artificial Sequence: Synthetic oligonucleotide
gatgggacgatctttggagtggtcttgggggactac

SEQ ID NO: 2986 - DNA, 36 bp, Artificial Sequence
  Description of Artificial Sequence: Synthetic oligonucleotide
gatgggacgatttttggagtgctcttgggggactac

SEQ ID NO: 2987 - DNA, 33 bp, Artificial Sequence
  Description of Artificial Sequence: Synthetic oligonucleotide
gataggacgatttttggagtggttcttgactac

SEQ ID NO: 2988 - DNA, 42 bp, Artificial Sequence
  Description of Artificial Sequence: Synthetic oligonucleotide
gaggccacgatttttggaatggttattgtaccgtttgactac

SEQ ID NO: 2989 - DNA, 42 bp, Artificial Sequence; identical to SEQ ID NO: 2988
  Description of Artificial Sequence: Synthetic oligonucleotide

SEQ ID NO: 2990 - DNA, 42 bp, Artificial Sequence
  Description of Artificial Sequence: Synthetic oligonucleotide
gaggccacgatttttggaatgcttattgtaccatttgactac

SEQ ID NO: 2991 - DNA, 42 bp, Artificial Sequence; identical to SEQ ID NO: 2990
  Description of Artificial Sequence: Synthetic oligonucleotide

SEQ ID NO: 2992 - DNA, 48 bp, Artificial Sequence
  Description of Artificial Sequence: Synthetic oligonucleotide
gatcgtattacgatttttggagtggttatggggggcggtatggacgtc

SEQ ID NO: 2993 - DNA, 33 bp, Artificial Sequence
  Description of Artificial Sequence: Synthetic oligonucleotide
gatcaggcgatttttggagtggtccccgactac

SEQ ID NO: 2994 - DNA, 36 bp, Artificial Sequence; identical to SEQ ID NO: 2986
  Description of Artificial Sequence: Synthetic oligonucleotide

SEQ ID NO: 2995 - DNA, 33 bp, Artificial Sequence
  Description of Artificial Sequence: Synthetic oligonucleotide
gatcggacgatttttggagtggtccttgagtac

SEQ ID NO: 2996 - DNA, 27 bp, Artificial Sequence
  Description of Artificial Sequence: Synthetic oligonucleotide
gatgtagcagtggctggctttgactac

SEQ ID NO: 2997 - DNA, 27 bp, Artificial Sequence
  Description of Artificial Sequence: Synthetic oligonucleotide
gatgtagcagtggctggctttgactac

SEQ ID NO: 2998 - DNA, 36 bp, Artificial Sequence; identical to SEQ ID NO: 2986
  Description of Artificial Sequence: Synthetic oligonucleotide

SEQ ID NO: 2999 - DNA, 36 bp, Artificial Sequence; identical to SEQ ID NO: 2986
  Description of Artificial Sequence: Synthetic oligonucleotide

SEQ ID NO: 3000 - DNA, 36 bp, Artificial Sequence; identical to SEQ ID NO: 2986
  Description of Artificial Sequence: Synthetic oligonucleotide

SEQ ID NO: 3001 - DNA, 36 bp, Artificial Sequence; identical to SEQ ID NO: 2986
  Description of Artificial Sequence: Synthetic oligonucleotide

SEQ ID NO: 3002 - DNA, 36 bp, Artificial Sequence; identical to SEQ ID NO: 2986
  Description of Artificial Sequence: Synthetic oligonucleotide

SEQ ID NO: 3003 - DNA, 36 bp, Artificial Sequence
  Description of Artificial Sequence: Synthetic oligonucleotide
gataggacgatttttggagtgctcttgggggactac

SEQ ID NO: 3004 - DNA, 36 bp, Artificial Sequence; identical to SEQ ID NO: 2985
  Description of Artificial Sequence: Synthetic oligonucleotide

SEQ ID NO: 3005 - DNA, 36 bp, Artificial Sequence; identical to SEQ ID NO: 2985
  Description of Artificial Sequence: Synthetic oligonucleotide

SEQ ID NO: 3006 - DNA, 36 bp, Artificial Sequence; identical to SEQ ID NO: 2985
  Description of Artificial Sequence: Synthetic oligonucleotide

SEQ ID NO: 3007 - DNA, 36 bp, Artificial Sequence; identical to SEQ ID NO: 2985
  Description of Artificial Sequence: Synthetic oligonucleotide

SEQ ID NO: 3008 - DNA, 36 bp, Artificial Sequence; identical to SEQ ID NO: 2985
  Description of Artificial Sequence: Synthetic oligonucleotide

SEQ ID NO: 3009 - DNA, 36 bp, Artificial Sequence
  Description of Artificial Sequence: Synthetic oligonucleotide
gataggacgatctttggagtggtcttgggggactac

SEQ ID NO: 3010 - DNA, 36 bp, Artificial Sequence; identical to SEQ ID NO: 2985
  Description of Artificial Sequence: Synthetic oligonucleotide

SEQ ID NO: 3011 - DNA, 36 bp, Artificial Sequence; identical to SEQ ID NO: 2985
  Description of Artificial Sequence: Synthetic oligonucleotide

SEQ ID NO: 3012 - DNA, 36 bp, Artificial Sequence; identical to SEQ ID NO: 2985
  Description of Artificial Sequence: Synthetic oligonucleotide

SEQ ID NO: 3013 - DNA, 36 bp, Artificial Sequence; identical to SEQ ID NO: 2985
  Description of Artificial Sequence: Synthetic oligonucleotide

SEQ ID NO: 3014 - DNA, 36 bp, Artificial Sequence; identical to SEQ ID NO: 2985
  Description of Artificial Sequence: Synthetic oligonucleotide

SEQ ID NO: 3015 - DNA, 36 bp, Artificial Sequence; identical to SEQ ID NO: 2985
  Description of Artificial Sequence: Synthetic oligonucleotide

SEQ ID NO: 3016 - DNA, 36 bp, Artificial Sequence; identical to SEQ ID NO: 2985
  Description of Artificial Sequence: Synthetic oligonucleotide

SEQ ID NO: 3017 - DNA, 36 bp, Artificial Sequence; identical to SEQ ID NO: 2985
  Description of Artificial Sequence: Synthetic oligonucleotide

SEQ ID NO: 3018 - DNA, 36 bp, Artificial Sequence; identical to SEQ ID NO: 2985
  Description of Artificial Sequence: Synthetic oligonucleotide

SEQ ID NO: 3019 - DNA, 36 bp, Artificial Sequence; identical to SEQ ID NO: 2985
  Description of Artificial Sequence: Synthetic oligonucleotide

SEQ ID NO: 3020 - DNA, 36 bp, Artificial Sequence; identical to SEQ ID NO: 2985
  Description of Artificial Sequence: Synthetic oligonucleotide

SEQ ID NO: 3021 - DNA, 36 bp, Artificial Sequence; identical to SEQ ID NO: 3009
  Description of Artificial Sequence: Synthetic oligonucleotide

SEQ ID NO: 3022 - DNA, 36 bp, Artificial Sequence; identical to SEQ ID NO: 2985
  Description of Artificial Sequence: Synthetic oligonucleotide

SEQ ID NO: 3023 - DNA, 33 bp, Artificial Sequence; identical to SEQ ID NO: 2987
  Description of Artificial Sequence: Synthetic oligonucleotide

SEQ ID NO: 3024 - DNA, 33 bp, Artificial Sequence; identical to SEQ ID NO: 2987
  Description of Artificial Sequence: Synthetic oligonucleotide

SEQ ID NO: 3025 - DNA, 33 bp, Artificial Sequence; identical to SEQ ID NO: 2987
  Description of Artificial Sequence: Synthetic oligonucleotide

SEQ ID NO: 3026 - DNA, 33 bp, Artificial Sequence; identical to SEQ ID NO: 2987
  Description of Artificial Sequence: Synthetic oligonucleotide

SEQ ID NO: 3027 - DNA, 33 bp, Artificial Sequence; identical to SEQ ID NO: 2987
  Description of Artificial Sequence: Synthetic oligonucleotide

SEQ ID NO: 3028 - DNA, 33 bp, Artificial Sequence; identical to SEQ ID NO: 2987
  Description of Artificial Sequence: Synthetic oligonucleotide

SEQ ID NO: 3029 - DNA, 33 bp, Artificial Sequence; identical to SEQ ID NO: 2987
  Description of Artificial Sequence: Synthetic oligonucleotide

SEQ ID NO: 3030 - DNA, 33 bp, Artificial Sequence; identical to SEQ ID NO: 2987
  Description of Artificial Sequence: Synthetic oligonucleotide

SEQ ID NO: 3031 - DNA, 33 bp, Artificial Sequence; identical to SEQ ID NO: 2987
  Description of Artificial Sequence: Synthetic oligonucleotide

SEQ ID NO: 3032 - DNA, 36 bp, Artificial Sequence; identical to SEQ ID NO: 2986
  Description of Artificial Sequence: Synthetic oligonucleotide

SEQ ID NO: 3033 - DNA, 36 bp, Artificial Sequence; identical to SEQ ID NO: 3003
  Description of Artificial Sequence: Synthetic oligonucleotide

SEQ ID NO: 3034 - DNA, 36 bp, Artificial Sequence; identical to SEQ ID NO: 2986
  Description of Artificial Sequence: Synthetic oligonucleotide

SEQ ID NO: 3035 - DNA, 36 bp, Artificial Sequence; identical to SEQ ID NO: 3003
  Description of Artificial Sequence: Synthetic oligonucleotide

SEQ ID NO: 3036 - DNA, 36 bp, Artificial Sequence; identical to SEQ ID NO: 2986
  Description of Artificial Sequence: Synthetic oligonucleotide

SEQ ID NO: 3037 - DNA, 36 bp, Artificial Sequence; identical to SEQ ID NO: 2986
  Description of Artificial Sequence: Synthetic oligonucleotide

SEQ ID NO: 3038 - DNA, 36 bp, Artificial Sequence; identical to SEQ ID NO: 2986
  Description of Artificial Sequence: Synthetic oligonucleotide

SEQ ID NO: 3039 - DNA, 33 bp, Artificial Sequence; identical to SEQ ID NO: 2995
  Description of Artificial Sequence: Synthetic oligonucleotide

SEQ ID NO: 3040 - DNA, 33 bp, Artificial Sequence; identical to SEQ ID NO: 2995
  Description of Artificial Sequence: Synthetic oligonucleotide

SEQ ID NO: 3041 - DNA, 33 bp, Artificial Sequence; identical to SEQ ID NO: 2995
  Description of Artificial Sequence: Synthetic oligonucleotide

SEQ ID NO: 3042 - DNA, 33 bp, Artificial Sequence; identical to SEQ ID NO: 2995
  Description of Artificial Sequence: Synthetic oligonucleotide

SEQ ID NO: 3043 - DNA, 33 bp, Artificial Sequence; identical to SEQ ID NO: 2995
  Description of Artificial Sequence: Synthetic oligonucleotide

SEQ ID NO: 3044 - DNA, 33 bp, Artificial Sequence; identical to SEQ ID NO: 2995
  Description of Artificial Sequence: Synthetic oligonucleotide

SEQ ID NO: 3045 - DNA, 33 bp, Artificial Sequence; identical to SEQ ID NO: 2995
  Description of Artificial Sequence: Synthetic oligonucleotide

SEQ ID NO: 3046 - DNA, 33 bp, Artificial Sequence; identical to SEQ ID NO: 2995
  Description of Artificial Sequence: Synthetic oligonucleotide

SEQ ID NO: 3047 - DNA, 33 bp, Artificial Sequence; identical to SEQ ID NO: 2995
  Description of Artificial Sequence: Synthetic oligonucleotide

SEQ ID NO: 3048 - DNA, 33 bp, Artificial Sequence; identical to SEQ ID NO: 2995
  Description of Artificial Sequence: Synthetic oligonucleotide

SEQ ID NO: 3049 - DNA, 33 bp, Artificial Sequence; identical to SEQ ID NO: 2995
  Description of Artificial Sequence: Synthetic oligonucleotide

SEQ ID NO: 3050 - DNA, 33 bp, Artificial Sequence
  Description of Artificial Sequence: Synthetic oligonucleotide
gggattacgatttttggtcatgggtttgaatat

SEQ ID NO: 3051 - DNA, 33 bp, Artificial Sequence; identical to SEQ ID NO: 3050
  Description of Artificial Sequence: Synthetic oligonucleotide

SEQ ID NO: 3052 - DNA, 33 bp, Artificial Sequence; identical to SEQ ID NO: 3050
  Description of Artificial Sequence: Synthetic oligonucleotide

SEQ ID NO: 3053 - DNA, 33 bp, Artificial Sequence; identical to SEQ ID NO: 3050
  Description of Artificial Sequence: Synthetic oligonucleotide

SEQ ID NO: 3054 - DNA, 33 bp, Artificial Sequence; identical to SEQ ID NO: 2993
  Description of Artificial Sequence: Synthetic oligonucleotide

SEQ ID NO: 3055 - DNA, 33 bp, Artificial Sequence; identical to SEQ ID NO: 2993
  Description of Artificial Sequence: Synthetic oligonucleotide

SEQ ID NO: 3056 - DNA, 33 bp, Artificial Sequence; identical to SEQ ID NO: 2993
  Description of Artificial Sequence: Synthetic oligonucleotide

SEQ ID NO: 3057 - DNA, 33 bp, Artificial Sequence; identical to SEQ ID NO: 2993
  Description of Artificial Sequence: Synthetic oligonucleotide

SEQ ID NO: 3058 - DNA, 33 bp, Artificial Sequence; identical to SEQ ID NO: 2993
  Description of Artificial Sequence: Synthetic oligonucleotide

SEQ ID NO: 3059 - DNA, 33 bp, Artificial Sequence; identical to SEQ ID NO: 2993
  Description of Artificial Sequence: Synthetic oligonucleotide

SEQ ID NO: 3060 - DNA, 33 bp, Artificial Sequence; identical to SEQ ID NO: 2993
  Description of Artificial Sequence: Synthetic oligonucleotide

SEQ ID NO: 3061 - DNA, 33 bp, Artificial Sequence; identical to SEQ ID NO: 2993
  Description of Artificial Sequence: Synthetic oligonucleotide

SEQ ID NO: 3062 - DNA, 48 bp, Artificial Sequence; identical to SEQ ID NO: 2992
  Description of Artificial Sequence: Synthetic oligonucleotide

SEQ ID NO: 3063 - DNA, 48 bp, Artificial Sequence; identical to SEQ ID NO: 2992
  Description of Artificial Sequence: Synthetic oligonucleotide

SEQ ID NO: 3064 - DNA, 48 bp, Artificial Sequence; identical to SEQ ID NO: 2992
  Description of Artificial Sequence: Synthetic oligonucleotide

SEQ ID NO: 3065 - DNA, 48 bp, Artificial Sequence; identical to SEQ ID NO: 2992
  Description of Artificial Sequence: Synthetic oligonucleotide

SEQ ID NO: 3066 - DNA, 48 bp, Artificial Sequence; identical to SEQ ID NO: 2992
  Description of Artificial Sequence: Synthetic oligonucleotide

SEQ ID NO: 3067 - DNA, 48 bp, Artificial Sequence; identical to SEQ ID NO: 2992
  Description of Artificial Sequence: Synthetic oligonucleotide

SEQ ID NO: 3068 - DNA, 48 bp, Artificial Sequence; identical to SEQ ID NO: 2992
  Description of Artificial Sequence: Synthetic oligonucleotide

SEQ ID NO: 3069 - DNA, 42 bp, Artificial Sequence; identical to SEQ ID NO: 2988
  Description of Artificial Sequence: Synthetic oligonucleotide

SEQ ID NO: 3070 - DNA, 42 bp, Artificial Sequence; identical to SEQ ID NO: 2988
  Description of Artificial Sequence: Synthetic oligonucleotide

SEQ ID NO: 3071 - DNA, 42 bp, Artificial Sequence; identical to SEQ ID NO: 2988
  Description of Artificial Sequence: Synthetic oligonucleotide

SEQ ID NO: 3072 - DNA, 42 bp, Artificial Sequence; identical to SEQ ID NO: 2988
  Description of Artificial Sequence: Synthetic oligonucleotide

SEQ ID NO: 3073 - DNA, 42 bp, Artificial Sequence; identical to SEQ ID NO: 2988
  Description of Artificial Sequence: Synthetic oligonucleotide

SEQ ID NO: 3074 - DNA, 42 bp, Artificial Sequence; identical to SEQ ID NO: 2988
  Description of Artificial Sequence: Synthetic oligonucleotide

SEQ ID NO: 3075 - DNA, 42 bp, Artificial Sequence; identical to SEQ ID NO: 2988
  Description of Artificial Sequence: Synthetic oligonucleotide

SEQ ID NO: 3076 - DNA, 42 bp, Artificial Sequence; identical to SEQ ID NO: 2988
  Description of Artificial Sequence: Synthetic oligonucleotide

SEQ ID NO: 3077 - DNA, 42 bp, Artificial Sequence; identical to SEQ ID NO: 2988
  Description of Artificial Sequence: Synthetic oligonucleotide

SEQ ID NO: 3078 - DNA, 42 bp, Artificial Sequence; identical to SEQ ID NO: 2988
  Description of Artificial Sequence: Synthetic oligonucleotide

SEQ ID NO: 3079 - DNA, 42 bp, Artificial Sequence; identical to SEQ ID NO: 2988
  Description of Artificial Sequence: Synthetic oligonucleotide

SEQ ID NO: 3080 - DNA, 42 bp, Artificial Sequence; identical to SEQ ID NO: 2990
  Description of Artificial Sequence: Synthetic oligonucleotide

SEQ ID NO: 3081 - DNA, 42 bp, Artificial Sequence; identical to SEQ ID NO: 2990
  Description of Artificial Sequence: Synthetic oligonucleotide

SEQ ID NO: 3082 - DNA, 42 bp, Artificial Sequence; identical to SEQ ID NO: 2990
  Description of Artificial Sequence: Synthetic oligonucleotide

SEQ ID NO: 3083 - DNA, 42 bp, Artificial Sequence; identical to SEQ ID NO: 2990
  Description of Artificial Sequence: Synthetic oligonucleotide

SEQ ID NO: 3084 - DNA, 42 bp, Artificial Sequence; identical to SEQ ID NO: 2990
  Description of Artificial Sequence: Synthetic oligonucleotide

SEQ ID NO: 3085 - DNA, 42 bp, Artificial Sequence; identical to SEQ ID NO: 2990
  Description of Artificial Sequence: Synthetic oligonucleotide

SEQ ID NO: 3086 - DNA, 42 bp, Artificial Sequence; identical to SEQ ID NO: 2990
  Description of Artificial Sequence: Synthetic oligonucleotide

SEQ ID NO: 3087 - DNA, 42 bp, Artificial Sequence; identical to SEQ ID NO: 2990
  Description of Artificial Sequence: Synthetic oligonucleotide

SEQ ID NO: 3088 - DNA, 42 bp, Artificial Sequence; identical to SEQ ID NO: 2990
  Description of Artificial Sequence: Synthetic oligonucleotide

SEQ ID NO: 3089 - DNA, 42 bp, Artificial Sequence; identical to SEQ ID NO: 2988
  Description of Artificial Sequence: Synthetic oligonucleotide

SEQ ID NO: 3090 - DNA, 42 bp, Artificial Sequence; identical to SEQ ID NO: 2988
  Description of Artificial Sequence: Synthetic oligonucleotide

SEQ ID NO: 3091 - DNA, 42 bp, Artificial Sequence; identical to SEQ ID NO: 2988
  Description of Artificial Sequence: Synthetic oligonucleotide

SEQ ID NO: 3092 - DNA, 42 bp, Artificial Sequence; identical to SEQ ID NO: 2988
  Description of Artificial Sequence: Synthetic oligonucleotide

SEQ ID NO: 3093 - DNA, 42 bp, Artificial Sequence; identical to SEQ ID NO: 2988
  Description of Artificial Sequence: Synthetic oligonucleotide

SEQ ID NO: 3094 - DNA, 42 bp, Artificial Sequence; identical to SEQ ID NO: 2990
  Description of Artificial Sequence: Synthetic oligonucleotide

SEQ ID NO: 3095 - DNA, 42 bp, Artificial Sequence; identical to SEQ ID NO: 2990
  Description of Artificial Sequence: Synthetic oligonucleotide

SEQ ID NO: 3096 - DNA, 42 bp, Artificial Sequence; identical to SEQ ID NO: 2990
  Description of Artificial Sequence: Synthetic oligonucleotide

SEQ ID NO: 3097 - DNA, 42 bp, Artificial Sequence; identical to SEQ ID NO: 2990
  Description of Artificial Sequence: Synthetic oligonucleotide

SEQ ID NO: 3098 - DNA, 42 bp, Artificial Sequence; identical to SEQ ID NO: 2990
  Description of Artificial Sequence: Synthetic oligonucleotide

SEQ ID NO: 3099 - DNA, 42 bp, Artificial Sequence; identical to SEQ ID NO: 2990
  Description of Artificial Sequence: Synthetic oligonucleotide

SEQ ID NO: 3100 - DNA, 42 bp, Artificial Sequence; identical to SEQ ID NO: 2990
  Description of Artificial Sequence: Synthetic oligonucleotide

SEQ ID NO: 3101 - DNA, 42 bp, Artificial Sequence; identical to SEQ ID NO: 2990
  Description of Artificial Sequence: Synthetic oligonucleotide

SEQ ID NO: 3102 - DNA, 42 bp, Artificial Sequence; identical to SEQ ID NO: 2990
  Description of Artificial Sequence: Synthetic oligonucleotide

SEQ ID NO: 3103 - DNA, 42 bp, Artificial Sequence; identical to SEQ ID NO: 2990
  Description of Artificial Sequence: Synthetic oligonucleotide

SEQ ID NO: 3104 - DNA, 42 bp, Artificial Sequence; identical to SEQ ID NO: 2990
  Description of Artificial Sequence: Synthetic oligonucleotide

SEQ ID NO: 3105 - DNA, 42 bp, Artificial Sequence; identical to SEQ ID NO: 2990
  Description of Artificial Sequence: Synthetic oligonucleotide

SEQ ID NO: 3106 - DNA, 42 bp, Artificial Sequence; identical to SEQ ID NO: 2990
  Description of Artificial Sequence: Synthetic oligonucleotide

SEQ ID NO: 3107 - DNA, 57 bp, Artificial Sequence; identical to SEQ ID NO: 2984
  Description of Artificial Sequence: Synthetic oligonucleotide

SEQ ID NO: 3108 - DNA, 57 bp, Artificial Sequence; identical to SEQ ID NO: 2984
  Description of Artificial Sequence: Synthetic oligonucleotide

SEQ ID NO: 3109 - DNA, 57 bp, Artificial Sequence; identical to SEQ ID NO: 2984
  Description of Artificial Sequence: Synthetic oligonucleotide

SEQ ID NO: 3110 - DNA, 57 bp, Artificial Sequence; identical to SEQ ID NO: 2984
  Description of Artificial Sequence: Synthetic oligonucleotide

SEQ ID NO: 3111 - DNA, 57 bp, Artificial Sequence; identical to SEQ ID NO: 2984
  Description of Artificial Sequence: Synthetic oligonucleotide

SEQ ID NO: 3112 - DNA, 57 bp, Artificial Sequence; identical to SEQ ID NO: 2984
  Description of Artificial Sequence: Synthetic oligonucleotide

SEQ ID NO: 3113 - DNA, 57 bp, Artificial Sequence; identical to SEQ ID NO: 2984
  Description of Artificial Sequence: Synthetic oligonucleotide

SEQ ID NO: 3114 - DNA, 57 bp, Artificial Sequence; identical to SEQ ID NO: 2984
  Description of Artificial Sequence: Synthetic oligonucleotide

SEQ ID NO: 3115 - DNA, 57 bp, Artificial Sequence; identical to SEQ ID NO: 2984
  Description of Artificial Sequence: Synthetic oligonucleotide

SEQ ID NO: 3116 - DNA, 57 bp, Artificial Sequence; identical to SEQ ID NO: 2984
  Description of Artificial Sequence: Synthetic oligonucleotide

SEQ ID NO: 3117 - DNA, 57 bp, Artificial Sequence; identical to SEQ ID NO: 2984
  Description of Artificial Sequence: Synthetic oligonucleotide

SEQ ID NO: 3118 - DNA, 57 bp, Artificial Sequence; identical to SEQ ID NO: 2984
  Description of Artificial Sequence: Synthetic oligonucleotide

SEQ ID NO: 3119 - DNA, 57 bp, Artificial Sequence
  Description of Artificial Sequence: Synthetic oligonucleotide
gggggggattacgttttcgggacttatcggcctcactactactacggtatggacgtc

SEQ ID NO: 3120 - DNA, 57 bp, Artificial Sequence; identical to SEQ ID NO: 3119
  Description of Artificial Sequence: Synthetic oligonucleotide

SEQ ID NO: 3121 - DNA, 36 bp, Artificial Sequence; identical to SEQ ID NO: 3009
  Description of Artificial Sequence: Synthetic oligonucleotide

SEQ ID NO: 3122 - DNA, 36 bp, Artificial Sequence; identical to SEQ ID NO: 3003
  Description of Artificial Sequence: Synthetic oligonucleotide

SEQ ID NO: 3123 - DNA, 57 bp, Artificial Sequence; identical to SEQ ID NO: 2984
  Description of Artificial Sequence: Synthetic oligonucleotide

SEQ ID NO: 3124 - DNA, 36 bp, Artificial Sequence
  Description of Artificial Sequence: Synthetic oligonucleotide
ggaaaagtggctggtatgcctgaagcttttgaaatc

SEQ ID NO: 3125 - DNA, 60 bp, Artificial Sequence
  Description of Artificial Sequence: Synthetic oligonucleotide
gggggtgattacgtttgggggagttatcgtccctactactactactacggtatggacgtc

SEQ ID NO: 3126 - DNA, 36 bp, Artificial Sequence; identical to SEQ ID NO: 3124
  Description of Artificial Sequence: Synthetic oligonucleotide

SEQ ID NO: 3127 - DNA, 36 bp, Artificial Sequence; identical to SEQ ID NO: 3124
  Description of Artificial Sequence: Synthetic oligonucleotide

SEQ ID NO: 3128 - DNA, 36 bp, Artificial Sequence; identical to SEQ ID NO: 3124
  Description of Artificial Sequence: Synthetic oligonucleotide

SEQ ID NO: 3129 - DNA, 36 bp, Artificial Sequence; identical to SEQ ID NO: 3124
  Description of Artificial Sequence: Synthetic oligonucleotide

SEQ ID NO: 3130 - DNA, 36 bp, Artificial Sequence; identical to SEQ ID NO: 3124
  Description of Artificial Sequence: Synthetic oligonucleotide

SEQ ID NO: 3131 - DNA, 36 bp, Artificial Sequence; identical to SEQ ID NO: 3124
  Description of Artificial Sequence: Synthetic oligonucleotide

SEQ ID NO: 3132 - DNA, 60 bp, Artificial Sequence; identical to SEQ ID NO: 3125
  Description of Artificial Sequence: Synthetic oligonucleotide

SEQ ID NO: 3133 - DNA, 60 bp, Artificial Sequence; identical to SEQ ID NO: 3125
  Description of Artificial Sequence: Synthetic oligonucleotide

SEQ ID NO: 3134 - DNA, 60 bp, Artificial Sequence; identical to SEQ ID NO: 3125
  Description of Artificial Sequence: Synthetic oligonucleotide

SEQ ID NO: 3135 - DNA, 60 bp, Artificial Sequence; identical to SEQ ID NO: 3125
  Description of Artificial Sequence: Synthetic oligonucleotide

SEQ ID NO: 3136 - DNA, 60 bp, Artificial Sequence; identical to SEQ ID NO: 3125
  Description of Artificial Sequence: Synthetic oligonucleotide

SEQ ID NO: 3137 - DNA, 60 bp, Artificial Sequence; identical to SEQ ID NO: 3125
  Description of Artificial Sequence: Synthetic oligonucleotide

SEQ ID NO: 3138 - DNA, 60 bp, Artificial Sequence
  Description of Artificial Sequence: Synthetic oligonucleotide
gggggtgattacgttttcgggagttatcgtccctactactactactacggtatggacgtc

SEQ ID NO: 3139 - DNA, 60 bp, Artificial Sequence; identical to SEQ ID NO: 3138
  Description of Artificial Sequence: Synthetic oligonucleotide

SEQ ID NO: 3140 - DNA, 36 bp, Artificial Sequence; identical to SEQ ID NO: 3124
  Description of Artificial Sequence: Synthetic oligonucleotide

SEQ ID NO: 3141 - protein, 466 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 3142 - DNA, 2024 bp, Homo sapiens
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggtggggagagacagagaagtgggcaggggcacccaagttgggatttcatttcaggtgcattggagattcttaggagtgtctcttgggggtaatattttattttttaaaaaatgaggat

SEQ ID NO: 3143 - protein, 430 aa, Homo sapiens
MTTSPILQLLLRLSLCGLLLQRAETGSKGQTAGELYQRWERYRRECQETLAAAEPPSVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 3144 - DNA, 1290 bp, Homo sapiens
atgaccaccagcccgattctgcagctgctgctgcgcctgagcctgtgcggcctgctgctgcagcgcgcggaaaccggcagcaaaggccagaccgcgggcgaactgtatcagcgctgggaacgctatcgccgcgaatgccaggaaaccctggcggcggcggaaccgccgagcgtggcggcgggctttgtgctgcgccagtgcggcagcgatggccagtggggcctgtggcgcgatcatacccagtgcgaaaacccggaaaaaaacgaagcgtttctggatcagcgcctgattctggaacgcctgcaggtgatgtataccgtgggctatagcctgagcctggcgaccctgctgctggcgctgctgattctgagcctgtttcgccgcctgcattgcacccgcaactatattcatattaacctgtttaccagctttatgctgcgcgcggcggcgattctgagccgcgatcgcctgctgccgcgcccgggcccgtatctgggcgatcaggcgctggcgctgtggaaccaggcgctggcggcgtgccgcaccgcgcagattgtgacccagtattgcgtgggcgcgaactatacctggctgctggtggaaggcgtgtatctgcatagcctgctggtgctggtgggcggcagcgaagaaggccattttcgctattatctgctgctgggctggggcgcgccggcgctgtttgtgattccgtgggtgattgtgcgctatctgtatgaaaacacccagtgctgggaacgcaacgaagtgaaagcgatttggtggattattcgcaccccgattctgatgaccattctgattaactttctgatttttattcgcattctgggcattctgctgagcaaactgcgcacccgccagatgcgctgccgcgattatcgcctgcgcctggcgcgcagcaccctgaccctggtgccgctgctgggcgtgcatgaagtggtgtttgcgccggtgaccgaagaacaggcgcgcggcgcgctgcgctttgcgaaactgggctttgaaatttttctgagcagctttcagggctttctggtgagcgtgctgtattgctttattaacaaagaagtgcagagcgaaattcgccgcggctggcatcattgccgcctgcgccgcagcctgggcgaagaacagcgccagctgccggaacgcgcgtttcgcgcgctgccgagcggcagcggcccgggcgaagtgccgaccagccgcggcctgagcagcggcaccctgccgggcccgggcaacgaagcgagccgcgaactggaaagctattgc

SEQ ID NO: 3145 - protein, 493 aa, Artificial Sequence
  Description of Artificial Sequence: Synthetic polypeptide
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVGRDPAAAPALWRRRGTAPPLSAIVSQVQSEIRRGWHHCRLRRSLGEEQRQLPERAFRALPSGSGPGEVPTSRGLSSGTLPGPGNEASRELESYC

SEQ ID NO: 3146 - DNA, 1482 bp, Artificial Sequence
  Description of Artificial Sequence: Synthetic polynucleotide
atgaccaccagcccgattctgcagctgctgctgcgcctgagcctgtgcggcctgctgctgcagcgcgcggaaaccggcagcaaaggccagaccgcgggcgaactgtatcagcgctgggaacgctatcgccgcgaatgccaggaaaccctggcggcggcggaaccgccgagcggcctggcgtgcaacggcagctttgatatgtatgtgtgctgggattatgcggcgccgaacgcgaccgcgcgcgcgagctgcccgtggtatctgccgtggcatcatcatgtggcggcgggctttgtgctgcgccagtgcggcagcgatggccagtggggcctgtggcgcgatcatacccagtgcgaaaacccggaaaaaaacgaagcgtttctggatcagcgcctgattctggaacgcctgcaggtgatgtataccgtgggctatagcctgagcctggcgaccctgctgctggcgctgctgattctgagcctgtttcgccgcctgcattgcacccgcaactatattcatattaacctgtttaccagctttatgctgcgcgcggcggcgattctgagccgcgatcgcctgctgccgcgcccgggcccgtatctgggcgatcaggcgctggcgctgtggaaccaggcgctggcggcgtgccgcaccgcgcagattgtgacccagtattgcgtgggcgcgaactatacctggctgctggtggaaggcgtgtatctgcatagcctgctggtgctggtgggcggcagcgaagaaggccattttcgctattatctgctgctgggctggggcgcgccggcgctgtttgtgattccgtgggtgattgtgcgctatctgtatgaaaacacccagtgctgggaacgcaacgaagtgaaagcgatttggtggattattcgcaccccgattctgatgaccattctgattaactttctgatttttattcgcattctgggcattctgctgagcaaactgcgcacccgccagatgcgctgccgcgattatcgcctgcgcctggcgcgcagcaccctgaccctggtgccgctgctgggcgtgcatgaagtggtgtttgcgccggtgaccgaagaacaggcgcgcggcgcgctgcgctttgcgaaactgggctttgaaatttttctgagcagctttcagggctttctggtgagcgtgctgtattgctttattaacaaagaagtgggccgcgatccggcggcggcgccggcgctgtggcgccgccgcggcaccgcgccgccgctgagcgcgattgtgagccaggtgcagagcgaaattcgccgcggctggcatcattgccgcctgcgccgcagcctgggcgaagaacagcgccagctgccggaacgcgcgtttcgcgcgctgccgagcggcagcggcccgggcgaagtgccgaccagccgcggcctgagcagcggcaccctgccgggcccgggcaacgaagcgagccgcgaactggaaagctattgctaa

SEQ ID NO: 3147 - protein, 460 aa, Mus musculus
MPLRLLLLLLWLWGLQWAETDSEGQTTTGELYQRWEHYGQECQKMLETTEPPSGLACNGSFDMYACWNYTAANTTARVSCPWYLPWFRQVSAGFVFRQCGSDGQWGSWRDHTQCENPEKNGAFQDQTLILERLQIMYTVGYSLSLTTLLLALLILSLFRRLHCTRNYIHMNLFTSFMLRAAAILTRDQLLPPLGPYTGDQAPTPWNQALAACRTAQIMTQYCVGANYTWLLVEGVYLHHLLVIVGRSEKGHFRCYLLLGWGAPALFVIPWVIVRYLRENTQCWERNEVKAIWWIIRTPILITILINFLIFIRILGILVSKLRTRQMRCPDYRLRLARSTLTLVPLLGVHEVVFAPVTEEQVEGSLRFAKLAFEIFLSSFQGFLVSVLYCFINKEVQSEIRQGWRHRRLRLSLQEQRPRPHQELAPRAVPLSSACREAAVGNALPSGMLHVPGDEVLESYC

SEQ ID NO: 3148 - DNA, 1383 bp, Mus musculus
atgccgctgcgcctgctgctgctgctgctgtggctgtggggcctgcagtgggcggaaaccgatagcgaaggccagaccaccaccggcgaactgtatcagcgctgggaacattatggccaggaatgccagaaaatgctggaaaccaccgaaccgccgagcggcctggcgtgcaacggcagctttgatatgtatgcgtgctggaactataccgcggcgaacaccaccgcgcgcgtgagctgcccgtggtatctgccgtggtttcgccaggtgagcgcgggctttgtgtttcgccagtgcggcagcgatggccagtggggcagctggcgcgatcatacccagtgcgaaaacccggaaaaaaacggcgcgtttcaggatcagaccctgattctggaacgcctgcagattatgtataccgtgggctatagcctgagcctgaccaccctgctgctggcgctgctgattctgagcctgtttcgccgcctgcattgcacccgcaactatattcatatgaacctgtttaccagctttatgctgcgcgcggcggcgattctgacccgcgatcagctgctgccgccgctgggcccgtataccggcgatcaggcgccgaccccgtggaaccaggcgctggcggcgtgccgcaccgcgcagattatgacccagtattgcgtgggcgcgaactatacctggctgctggtggaaggcgtgtatctgcatcatctgctggtgattgtgggccgcagcgaaaaaggccattttcgctgctatctgctgctgggctggggcgcgccggcgctgtttgtgattccgtgggtgattgtgcgctatctgcgcgaaaacacccagtgctgggaacgcaacgaagtgaaagcgatttggtggattattcgcaccccgattctgattaccattctgattaactttctgatttttattcgcattctgggcattctggtgagcaaactgcgcacccgccagatgcgctgcccggattatcgcctgcgcctggcgcgcagcaccctgaccctggtgccgctgctgggcgtgcatgaagtggtgtttgcgccggtgaccgaagaacaggtggaaggcagcctgcgctttgcgaaactggcgtttgaaatttttctgagcagctttcagggctttctggtgagcgtgctgtattgctttattaacaaagaagtgcagagcgaaattcgccagggctggcgccatcgccgcctgcgcctgagcctgcaggaacagcgcccgcgcccgcatcaggaactggcgccgcgcgcggtgccgctgagcagcgcgtgccgcgaagcggcggtgggcaacgcgctgccgagcggcatgctgcatgtgccgggcgatgaagtgctggaaagctattgctaa

SEQ ID NO: 3149 - protein, 230 aa, Artificial Sequence
  Description of Artificial Sequence: Synthetic polypeptide
MPLRLLLLLLWLWGLQWAETDSEGQTTTGELYQRWEHYGQECQKMLETTEPPSGLACNGSFDMYACWNYTAANTTARVSCPWYLPWFRQVSAGFVFRQCGSDGQWGSWRDHTQCENPEKNGAFQDQTLILERLQIMYTVGYSLSLTTLLLALLILSLFRRLHCTRNYIHMNLFTSFMLRAAAILTRDQLLPPLGPYTGDQAPTPWNQVLHRLLPGGTKTFPIYFRTFPHH

SEQ ID NO: 3150 - DNA, 693 bp, Artificial Sequence
  Description of Artificial Sequence: Synthetic polynucleotide
atgccgctgcgcctgctgctgctgctgctgtggctgtggggcctgcagtgggcggaaaccgatagcgaaggccagaccaccaccggcgaactgtatcagcgctgggaacattatggccaggaatgccagaaaatgctggaaaccaccgaaccgccgagcggcctggcgtgcaacggcagctttgatatgtatgcgtgctggaactataccgcggcgaacaccaccgcgcgcgtgagctgcccgtggtatctgccgtggtttcgccaggtgagcgcgggctttgtgtttcgccagtgcggcagcgatggccagtggggcagctggcgcgatcatacccagtgcgaaaacccggaaaaaaacggcgcgtttcaggatcagaccctgattctggaacgcctgcagattatgtataccgtgggctatagcctgagcctgaccaccctgctgctggcgctgctgattctgagcctgtttcgccgcctgcattgcacccgcaactatattcatatgaacctgtttaccagctttatgctgcgcgcggcggcgattctgacccgcgatcagctgctgccgccgctgggcccgtataccggcgatcaggcgccgaccccgtggaaccaggtgctgcatcgcctgctgccgggcggcaccaaaacctttccgatttattttcgcacctttccgcatcattaa

SEQ ID NO: 3151 - protein, 42 aa, Homo sapiens
YAEGTFISDYSIAMDKIHQQDFVNWLLAQKGKKNDWKHNITQ

SEQ ID NO: 3152 - DNA, 126 bp, Homo sapiens
tatgcggaaggcacctttattagcgattatagcattgcgatggataaaattcatcagcaggattttgtgaactggctgctggcgcagaaaggcaaaaaaaacgattggaaacataacattacccag

SEQ ID NO: 3153 - protein, 42 aa, Mus musculus
YAEGTFISDYSIAMDKIRQQDFVNWLLAQRGKKSDWKHNITQ

SEQ ID NO: 3154 - DNA, 126 bp, Mus musculus
tatgcggaaggcacctttattagcgattatagcattgcgatggataaaattcgccagcaggattttgtgaactggctgctggcgcagcgcggcaaaaaaagcgattggaaacataacattacccag

SEQ ID NO: 3155 - protein, 42 aa, Rattus sp.
YAEGTFISDYSIAMDKIRQQDFVNWLLAQKGKKNDWKHNLTQ

SEQ ID NO: 3156 - DNA, 126 bp, Rattus sp.
tatgcggaaggcacctttattagcgattatagcattgcgatggataaaattcgccagcaggattttgtgaactggctgctggcgcagaaaggcaaaaaaaacgattggaaacataacctgacccag

SEQ ID NO: 3157 - protein, 22 aa, Homo sapiens
MDMRVPAQLLGLLLLWLRGARC

SEQ ID NO: 3158 - DNA, 66 bp, Homo sapiens
atggacatgagagtgcctgcacagctgctgggcctgctgctgctgtggctgagaggcgccagatgc

SEQ ID NO: 3159 - protein, 19 aa, Homo sapiens
MAWALLLLTLLTQGTGSWA

SEQ ID NO: 3160 - DNA, 57 bp, Homo sapiens
atggcctgggctctgctgctcctcaccctcctcactcagggcacagggtcctgggcc

SEQ ID NO: 3161 - protein, 239 aa, Artificial Sequence
  Description of Artificial Sequence: Synthetic polypeptide
MKLPVRLLVLMFWIPASSSDVVMTQTPLSLPVSLGDQASISCRSSQSLVHSNGDTYLHWYLQKPGQSPKLLIYKVSNRFSGVPDRFSGSGSGTDFTLKISRVEAADLGVYFCSQSTHVPPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3162 - protein, 462 aa, Artificial Sequence
  Description of Artificial Sequence: Synthetic polypeptide
MGWSYIILFLVATATDVHSQVQLQQPGAELVKPGASVKLSCRASGYTFTSNWMHWVKQRPRQGLEWIGEINPSNGRSNYNEKFKTKATLTVDKSSSTAYMQLSSLTSEDSAVYYCARFYYGTSWFAYWGQGTLVAVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFASTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 3163 - protein, 39 aa, Heloderma suspectum
HGEGTFTSDLSKQMEEEAVRLFIEWLKNGGPSSGAPPPS

SEQ ID NO: 3164 - protein, 39 aa, Heloderma horridum
HSDGTFTSDLSKQMEEEAVRLFIEWLKNGGPSSGAPPPS

SEQ ID NO: 3165 - protein, 39 aa, Heloderma suspectum
HGEGTFTSDLSKQLEEEAVRLFIEWLKNGGPSSGAPPPS

SEQ ID NO: 3166 - protein, 39 aa, Heloderma suspectum
HGEGTFTSDLSKQLEEEAVRLFIEFLKNGGPSSGAPPPS

SEQ ID NO: 3167 - protein, 39 aa, Heloderma suspectum
HGEGTFTSDLSKQLEEEAARLFIEFLKNGGPSSGAPPPS

SEQ ID NO: 3168 - protein, 30 aa, Heloderma suspectum
HGEGTFTSDLSKQMEEEAVRLFIEWLKNGG

SEQ ID NO: 3169 - protein, 30 aa, Heloderma suspectum
HGEGTFTSDLSKQLEEEAVRLFIEWLKNGG

SEQ ID NO: 3170 - protein, 30 aa, Heloderma suspectum
HGEGTFTSDLSKQLEEEAVRLFIEFLKNGG

SEQ ID NO: 3171 - protein, 30 aa, Heloderma suspectum
HGEGTFTSDLSKQLEEEAARLFIEFLKNGG

SEQ ID NO: 3172 - protein, 28 aa, Heloderma suspectum
HGEGTFTSDLSKQMEEEAVRLFIEWLKN

SEQ ID NO: 3173 - protein, 28 aa, Heloderma suspectum
HGEGTFTSDLSKQLEEEAVRLFIEWLKN

SEQ ID NO: 3174 - protein, 28 aa, Heloderma suspectum
HGEGTFTSDLSKQLEEEAVRLFIEFLKN

SEQ ID NO: 3175 - protein, 28 aa, Heloderma suspectum
HGEGTFTSDLSKQLEEEAARLFIEFLKN

SEQ ID NO: 3176 - protein, 39 aa, Heloderma suspectum
HGEGTFTSDLSKQLEEKAAKEFIEFLKQGGPSSGAPPPS

SEQ ID NO: 3177 - protein, 39 aa, Heloderma suspectum
HGEGTFTSDLSKQLEEKAAKEFIEWLKQGGPSSGAPPPS

SEQ ID NO: 3178 - protein, 39 aa, Heloderma suspectum
  MOD_RES (14)..(14): OctylGly
HGEGTFTSDLSKQGEEEAVRLFIEWLKQGGPSSGAPPPS

SEQ ID NO: 3179 - protein, 39 aa, Heloderma suspectum
  MOD_RES (34)..(34): OctylGly
HGEGTFTSDLSKQLEEEAVRLFIEWLKQGGPSSGAPPPS

SEQ ID NO: 3180 - protein, 37 aa, Heloderma suspectum
HGEFTFTSDLSKQLEEEAVRLFIEWLKQGGPSKEIIS

SEQ ID NO: 3181 - protein, 39 aa, Heloderma suspectum
HGEFTFTSDLSKQLEEKAAKEFIEWLKQGGPSSGAPPPS

SEQ ID NO: 3182 - protein, 39 aa, Heloderma suspectum
HGEGTFTSDLVKILEAEAVRKFIEFLKNGGPSSGAPPPS

SEQ ID NO: 3183 - protein, 40 aa, Heloderma suspectum
HGEGTFTSDLSKQMEEEAVRLFIEWLKNGGPSSGAPPPSK

SEQ ID NO: 3184 - protein, 31 aa, Homo sapiens
HAEGTFTSDVSSYLEGQAAKEFIAWLVKGRG

SEQ ID NO: 3185 - protein, 30 aa, Artificial Sequence
  Description of Artificial Sequence: Synthetic polypeptide
HAEGTFTSDVSSYLEGQAAKEFIAWLVKGR

SEQ ID NO: 3186 - protein, 30 aa, Artificial Sequence
  Description of Artificial Sequence: Synthetic polypeptide
  MOD_RES (2)..(2): Aib
  MOD_RES (29)..(29): Aib
HXEGTFTSDVSSYLEGQAAREFIAFLVRXR

SEQ ID NO: 3187 - protein, 31 aa, Artificial Sequence
  Description of Artificial Sequence: Synthetic polypeptide
  MOD_RES (2)..(2): Ala, Val or Gly
  MOD_RES (16)..(16): Gly, Lys or Glu
  MOD_RES (17)..(17): Gln or Lys
  MOD_RES (24)..(24): Ala or Glu
  MOD_RES (27)..(27): Val or Lys
  MOD_RES (28)..(28): Lys, Asn or Arg
  MOD_RES (30)..(30): Arg or Gly
  MOD_RES (31)..(31): Gly, His, Pro or not present
HXEGTFTSDVSSYLEXXAAKEFIXWLXXGXX

SEQ ID NO: 3188 - protein, 31 aa, Artificial Sequence
  Description of Artificial Sequence: Synthetic polypeptide
HAEGTFTSDVSSYLEGQAAKEFIAWLVRGRG

SEQ ID NO: 3189 - protein, 31 aa, Artificial Sequence
  Description of Artificial Sequence: Synthetic polypeptide
HAEGTFTSDVSSYLEGQAAKEFIEWLVKGRG

SEQ ID NO: 3190 - protein, 31 aa, Artificial Sequence
  Description of Artificial Sequence: Synthetic polypeptide
HAEGTFTSDVSSYLEKQAAKEFIAWLVKGRG

SEQ ID NO: 3191 - protein, 31 aa, Artificial Sequence
  Description of Artificial Sequence: Synthetic polypeptide
HGEGTFTSDVSSYLEEQAAKEFIAWLVKGGG

SEQ ID NO: 3192 - protein, 31 aa, Artificial Sequence
  Description of Artificial Sequence: Synthetic polypeptide
HVEGTFTSDVSSYLEEQAAKEFIAWLVKGGG

SEQ ID NO: 3193 - protein, 31 aa, Artificial Sequence
  Description of Artificial Sequence: Synthetic polypeptide
HGEGTFTSDVSSYLEEQAAKEFIAWLKNGGG

SEQ ID NO: 3194 - protein, 31 aa, Artificial Sequence
  Description of Artificial Sequence: Synthetic polypeptide
HVEGTFTSDVSSYLEEQAAKEFIAWLKNGGG

SEQ ID NO: 3195 - protein, 31 aa, Artificial Sequence
  Description of Artificial Sequence: Synthetic polypeptide
HGEGTFTSDVSSYLEEQAAKEFIAWLVKGGP

SEQ ID NO: 3196 - protein, 31 aa, Artificial Sequence
  Description of Artificial Sequence: Synthetic polypeptide
HVEGTFTSDVSSYLEEQAAKEFIAWLVKGGP

SEQ ID NO: 3197 - protein, 31 aa, Artificial Sequence
  Description of Artificial Sequence: Synthetic polypeptide
HGEGTFTSDVSSYLEEQAAKEFIAWLKNGGP

SEQ ID NO: 3198 - protein, 31 aa, Artificial Sequence
  Description of Artificial Sequence: Synthetic polypeptide
HVEGTFTSDVSSYLEEQAAKEFIAWLKNGGP

SEQ ID NO: 3199 - protein, 30 aa, Artificial Sequence
  Description of Artificial Sequence: Synthetic polypeptide
HGEGTFTSDVSSYLEEQAAKEFIAWLVKGG

SEQ ID NO: 3200 - protein, 30 aa, Artificial Sequence
  Description of Artificial Sequence: Synthetic polypeptide
HVEGTFTSDVSSYLEEQAAKEFIAWLVKGG

SEQ ID NO: 3201 - protein, 30 aa, Artificial Sequence
  Description of Artificial Sequence: Synthetic polypeptide
HVEGTFTSDVSSYLEEQAAKEFIAWLVNGG

SEQ ID NO: 3202 - protein, 30 aa, Artificial Sequence
  Description of Artificial Sequence: Synthetic polypeptide
HGEGTFTSDVSSYLEEQAAKEFIAWLVNGG

SEQ ID NO: 3203 - protein, 230 aa, Artificial Sequence
  Description of Artificial Sequence: Synthetic polypeptide
  MOD_RES (16)..(16): Pro or Glu
  MOD_RES (17)..(17): Phe, Val or Ala
  MOD_RES (18)..(18): Leu, Glu or Ala
  MOD_RES (80)..(80): Asn or Ala
  MISC_FEATURE (230)..(230): May or may not be present
AESKYGPPCPPCPAPXXXGGPSVFLFPPKPKDTLMISRTPEVTCVVVDVSQEDPEVQFNWYVDGVEVHNAKTKPREEQFXSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3204 - protein, 30 aa, Artificial Sequence
  Description of Artificial Sequence: Synthetic polypeptide
  MISC_FEATURE (1)..(30): This sequence may encompass 1-6 "Gly Gly Gly Gly Ser" repeating units wherein some positions may be absent
  See specification as filed for detailed description of substitutions and preferred embodiments
GGGGSGGGGSGGGGSGGGGSGGGGSGGGGS

SEQ ID NO: 3205 - protein, 275 aa, Homo sapiens
HGEGTFTSDVSSYLEEQAAKEFIAWLVKGGGGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3206 - protein, 40 aa, Artificial Sequence
  Description of Artificial Sequence: Synthetic polypeptide
  MOD_RES (2)..(2): D-Ala, Gly, Val, Leu, Ile, Ser or Thr
  MOD_RES (16)..(16): Gly, Glu, Asp or Lys
  MOD_RES (27)..(27): Val or Ile
  See specification as filed for detailed description of substitutions and preferred embodiments
HXEGTFTSDVSSYLEXQAAKEFIAWLXKGGPSSGAPPPCC

SEQ ID NO: 3207 - protein, 40 aa, Artificial Sequence
  Description of Artificial Sequence: Synthetic polypeptide
  See specification as filed for detailed description of substitutions and preferred embodiments
HVEGTFTSDVSSYLEEQAAKEFIAWLIKGGPSSGAPPPCC

SEQ ID NO: 3208 - protein, 39 aa, Artificial Sequence
  Description of Artificial Sequence: Synthetic polypeptide
HGEGTFTSDLSKQMEEEAVKLFIEWLKNGGPSSGAPPPS

SEQ ID NO: 3209 - protein, 39 aa, Artificial Sequence
  Description of Artificial Sequence: Synthetic polypeptide
HGEGTFTSDLSKQMEEEAVRLFIEWLKNGGPKSGAPPPS

SEQ ID NO: 3210 - protein, 38 aa, Artificial Sequence
  Description of Artificial Sequence: Synthetic polypeptide
GEGTFTSDLSKQMEEEAVKLFIEWLKNGGPSSGAPPPS

SEQ ID NO: 3211 - protein, 39 aa, Artificial Sequence
  Description of Artificial Sequence: Synthetic polypeptide
  MOD_RES (14)..(14): NorLeu
HGEGTFTSDLSRQXEEEAVRLFIEWLRNGGPKSGAPPPS

SEQ ID NO: 3212 - protein, 39 aa, Artificial Sequence; identical to SEQ ID NO: 3208
  Description of Artificial Sequence: Synthetic polypeptide

SEQ ID NO: 3213 - protein, 39 aa, Artificial Sequence; identical to SEQ ID NO: 3208
  Description of Artificial Sequence: Synthetic polypeptide

SEQ ID NO: 3214 - protein, 39 aa, Artificial Sequence; identical to SEQ ID NO: 3208
  Description of Artificial Sequence: Synthetic polypeptide

SEQ ID NO: 3215 - protein, 39 aa, Artificial Sequence; identical to SEQ ID NO: 3208
  Description of Artificial Sequence: Synthetic polypeptide

SEQ ID NO: 3216 - protein, 40 aa, Artificial Sequence; identical to SEQ ID NO: 3183
  Description of Artificial Sequence: Synthetic polypeptide

SEQ ID NO: 3217 - protein, 40 aa, Artificial Sequence; identical to SEQ ID NO: 3183
  Description of Artificial Sequence: Synthetic polypeptide

SEQ ID NO: 3218 - protein, 40 aa, Artificial Sequence; identical to SEQ ID NO: 3183
  Description of Artificial Sequence: Synthetic polypeptide

SEQ ID NO: 3219 - protein, 40 aa, Artificial Sequence; identical to SEQ ID NO: 3183
  Description of Artificial Sequence: Synthetic polypeptide

SEQ ID NO: 3220 - protein, 40 aa, Artificial Sequence; identical to SEQ ID NO: 3183
  Description of Artificial Sequence: Synthetic polypeptide

SEQ ID NO: 3221 - protein, 40 aa, Artificial Sequence; identical to SEQ ID NO: 3183
  Description of Artificial Sequence: Synthetic polypeptide

SEQ ID NO: 3222 - protein, 30 aa, Artificial Sequence
  Description of Artificial Sequence: Synthetic polypeptide
AEGTFTSDVSSYLEGQAAREFIAWLVKGRG

SEQ ID NO: 3223 - protein, 30 aa, Artificial Sequence; identical to SEQ ID NO: 3222
  Description of Artificial Sequence: Synthetic polypeptide

SEQ ID NO: 3224 - protein, 32 aa, Artificial Sequence
  Description of Artificial Sequence: Synthetic polypeptide
HAEGTFTSDVSSYLEGQAAREFIAWLVRGRGK

SEQ ID NO: 3225 - protein, 32 aa, Artificial Sequence; identical to SEQ ID NO: 3224
  Description of Artificial Sequence: Synthetic polypeptide

What is claimed is:

1. An isolated antigen binding protein that specifically binds to a human gastric inhibitory peptide receptor (GIPR) polypeptide, wherein said antigen binding protein is an antibody or a fragment thereof, and wherein said antibody comprises a CDRL1, a CDRL2, a CDRL3, a CDRH1, a CDRH2, and a CDRH3 wherein said. CDRL1 comprises SEQ ID NO: 702 ; said CDRL2 comprises SEQ ID NO: 859; said CDRL3 comprises SEQ ID NO: 1016; said CDRH1 comprises SEQ ID NO: 1173; said CDRH2 comprises SEQ ID NO: 1330; and said CDRH3 comprises SEQ ID NO: 1487.

2. The isolated antigen binding protein of claim 1, wherein said human GIPR has a sequence comprising a sequence selected from the group consisting of SEQ ID NO: 3141, SEQ ID NO: 3143, and SEQ ID NO: 3145.

3. The isolated antigen binding protein of claim 1 or 2, wherein said antigen binding protein is a monoclonal antibody, a polyclonal antibody, a recombinant antibody, a human antibody, a humanized antibody, a chimeric antibody, a multispecific antibody, or an antibody fragment thereof.

4. The isolated antigen binding protein of claim 3 wherein, said antibody fragment is a Fab fragment, a Fab' fragment, or a F(ab')2 fragment.

5. The isolated antigen binding protein of claim 3, wherein said antigen binding protein is a human antibody.

6. The isolated antigen binding protein of claim 3, wherein said antigen binding protein is a monoclonal antibody.

7. The isolated antigen binding protein of claim 3, wherein said antigen binding protein is of the IgG1-, IgG2- IgG3- or IgG4-type.

8. The isolated antigen binding protein of claim 7, wherein said antigen binding protein is of the IgG1- or the IgG2-type.

9. The isolated antigen binding protein of any of claim 3, wherein said antigen binding protein is coupled to a labeling group.

10. The isolated antigen binding protein of one of claim 3, wherein said antigen binding protein inhibits binding of GIP to the extracellular portion of human GIPR.

11. The isolated antigen binding protein of claim 3. wherein said antigen binding protein is an antibody or a fragment thereof, and wherein said antibody or fragment thereof comprises a light chain variable region comprising SEQ ID NO: 74 and a heavy chain variable region comprising SEQ ID NO: 231.

12. The isolated antigen binding protein of claim 3, wherein said antigen binding protein is an antibody, and wherein said antibody comprises a light chain comprising SEQ ID NO: 388 and a heavy chain comprising SEQ ID NO: 545.

13. The isolated antigen binding protein of claim 1, wherein said antibody comprises a CDRL1, a CDRL2, a CDRL3, a CDRH1, a CDRH2, and a CDRH3, wherein said CDRL1 consists of SEQ ID NO: 702 ; said CDRL2 consists of SEQ ID NO: 859; said CDRL3consists of SEQ ID NO: 1016; said CDRH1 consists of SEQ ID NO: 1173; said CDRH2 consists of SEQ ID NO: 1330; and said CDRH3 consists of SEQ ID NO: 1487.

14. A pharmaceutical composition comprising at least one antibody or fragment thereof according to any one of claims 1, 11, 12, and 13, and pharmaceutically acceptable excipient.

* * * * *